(12) United States Patent
Polakis

(10) Patent No.: US 8,147,827 B2
(45) Date of Patent: Apr. 3, 2012

(54) TUMOR TREATMENT

(75) Inventor: Paul Polakis, Burlingame, CA (US)

(73) Assignee: Genentech, Inc., South San Francisco, CA (US)

( * ) Notice: Subject to any disclaimer, the term of this patent is extended or adjusted under 35 U.S.C. 154(b) by 1969 days.

(21) Appl. No.: 11/155,987

(22) Filed: Jun. 17, 2005

(65) Prior Publication Data

US 2006/0003960 A1 Jan. 5, 2006

Related U.S. Application Data

(60) Provisional application No. 60/580,745, filed on Jun. 18, 2004.

(51) Int. Cl.
*A61K 39/395* (2006.01)
(52) U.S. Cl. .................... 424/130.1; 424/178.1
(58) Field of Classification Search ............... None
See application file for complete search history.

(56) References Cited

U.S. PATENT DOCUMENTS

2002/0068690 A1   6/2002   Baldwin et al.

FOREIGN PATENT DOCUMENTS

| WO | WO 00/73479 | 12/2000 |
|----|-------------|---------|
| WO | WO 00/74634 | 12/2000 |
| WO | WO 02/072008 | 9/2002 |
| WO | WO 03/013535 | 2/2003 |
| WO | WO 2004/091634 | 10/2004 |

OTHER PUBLICATIONS

Murphy et al (Oncology, Jul. 2001. vol. 15, No. 7, Supplement, pp. 47-52).*
Brakenhoff et al (Cancer Immunol Immunother. 1995. vol. 40, pp. 191-200).*
Boyer et al. (Anticancer Research, 2004. vol. 24, pp. 417-424).*
Xu et al. (Annals of Oncology, 2002. vol. 13, pp. 1841-1851).*
Mocellin et al. Annals of Surgery, 2005. vol. 241, No. 1, pp. 16-26.*
Gura, Science, 1997. vol. 278, pp. 1041-1042).*
Adlard et al., "Prediction of the Response of Colorectal Cancer to Systemic Therapy", Lancet Oncology, Lancet Publishing Group, London, GB, vol. 3, No. 2, pp. 75-85 (2002), XP004811698 ISSN: 1470-2045.
Adjei, "A review of the pharmacology and clinical activity of new chemotherapy agents for the treatment of colorectal cancer", Br. J. Clin. Pharmacol., 48: 265-277, (1999).
Ahr, et al., "Identification of high risk breast-cancer patients by gene expression profiling", The Lancet, vol. 359, pp. 131-132, (2002).
Ayabe, et al., "Activation of paneth cell α-defensins in mouse small intestine", The Journal of Biological Chemistry, vol. 277, No. 7, pp. 5219-5228, (2002).
Bhattacharjee, et al., "Classification of human lung carcinomas by mRNA expression profiling reveals distinct adenocarcinoma subclasses", PNAS, vol. 98, No. 24, pp. 13790-13795, (2001).

Dowsett, et al., "Role of biologic markers in patient selection and application to disease prevention", Am. J. Clin., 26(4 Suppl. 1): S34-S39, (2003).
Golub, et al., "Molecular classification of cancer: Class discovery and class prediction by gene expression monitoring", Science, vol. 286, pp. 531-537, (1999).
Greenlee, et al., "Cancer Statistics, 2001", Ca. Cancer J. Clin., 51: 15-36, (2001).
Martin, et al., "Linking gene expression patterns to therapeutic groups in breast cancer", Cancer Research, 60: 2232-2238, (2000).
Maxwell, et al., "Identification of 5-fluorouracil-inducible target genes using cDNA microarray profiling", Cancer Research, 63: 4602-4606, (2003).
Oosterhoff, et al., "Gene-directed enzyme prodrug therapy for osteosarcoma: Sensitization to CPT-11 in vitro and in vivo by adenoviral delivery of a gene encoding secreted carboxylesterase-2", Molecular Cancer Therapeutics, vol. 2, pp. 765-771, (2003).
Poon, et al., "Biochemical modulation of fluorouracil with leucovorin: confirmatory evidence of improved therapeutic efficacy in advanced colorectal cancer", Journal of Clinical Oncology, vol. 9, No. 11, pp. 1967-1972, (1991).
Ragnhammar, et al., "A systematic overview of chemotherapy effects in colorectal cancer", Acta. Oncologica, vol. 40, No. 2/3, pp. 282-308, (2001).
Ramaswamy, et al., "Multiclass cancer diagnosis using tumor gene expression signatures", PNAS, vol. 98, No. 26, pp. 15149-15154, (2001).
Saltz, et al., "Irinotecan plus fluorouracil and leucovorin for metastatic colorectal cancer", The New England Journal of Medicine, vol. 343, No. 13, pp. 905-914, (2000).
Sorlie, et al., "Gene expression patterns of breast carcinomas distinguish tumor subclass with clinical implications", PNAS, vol. 98, No. 19, pp. 10569-10874, (2001).
Tebbutt, et al., "Systemic treatment of colorectal", European Journal of Cancer, 38: 1000-1015, (2000).
Van de Vijver, et al., "A gene expression signature as a predictor of survival in breast cancer", The New England Journal of Medicine, vol. 347, No. 25, pp. 1999-2009, (2002). Van't Veer, et al., "Gene expression profiling predicts clinical outcome of breast cancer", Nature, vol. 415, pp. 530-536, (2002).
West, et al., "Predicting the clinical status of human breast cancer by using gene expression profiles", PNAS, vol. 98, No. 20, pp. 11462-11467, (2001).
Yan, et al., "Dissecting complex epigenetic alterations in breast cancer using CpG island microarrays", Cancer Research, 61: 8375-8380, (2001).
Yeang, et al., "Molecular classification of multiple tumor types", Bioinformatics, vol. 17, Suppl. 1, pp. S316-S322, (2001).

* cited by examiner

*Primary Examiner* — Celine Qian
(74) *Attorney, Agent, or Firm* — Arnold & Porter LLP; Janet Martineau; Ginger R. Dreger

(57) ABSTRACT

The invention concerns an improved method for treating tumor, including cancer, which combines the administration of a chemotherapeutic agent and an antagonist of a gene product the expression of which is upregulated by the chemotherapeutic agent. The invention further concerns methods and means for the diagnosis and classification of tumors, and for the prognosis of the outcome of tumor treatment, and patient response to a particular treatment modality.

9 Claims, 8 Drawing Sheets

Saline CPT-11

TUMOR TREATMENT

CROSS REFERENCE TO RELATED APPLICATIONS

This is a non-provisional application filed under 37 C.F.R. 1.53(b), claiming priority under U.S.C. Section 119(e) to Provisional Application Ser. No. 60/580,745, filed on Jun. 18, 2004.

INCORPORATION OF SEQUENCE LISTING

The instant application contains a Sequence Listing which has been submitted via EFS-Web and is hereby incorporated by reference in its entirety. Said ASCII copy, created on Oct. 22, 2009, is named GNE0150U.txt, and is 667,963 bytes in size.

BACKGROUND OF THE INVENTION

1. Field of the Invention

The present invention relates to the treatment of tumor. In particular, the invention concerns an improved method for treating tumor, including cancer, which combines the administration of a chemotherapeutic agent and an antagonist of a gene product the expression of which is upregulated by the chemotherapeutic agent. The invention further concerns methods and means for the diagnosis and classification of tumors, and for the prognosis of the outcome of tumor treatment, and patient response to a particular treatment modality.

2. Description of the Related Art

Colorectal cancer is a leading cause of cancer mortality in Westernized countries accounting for over 50,000 deaths per year in the United States alone (Greenlee et al. Cancer statistics, 2001, *CA Cancer J. Clin.* 51:15-36). Approximately 50% of the patients diagnosed with colorectal cancer are treated successfully by surgical resection of the primary tumor. The remaining patients are either diagnosed with or, subsequent to surgery, progress to advanced disease where the 5-year survival rate drops precipitously due to invasion and metastasis of the primary lesion (Adjei, A. A. (1999), *Br. J. Clin. Pharmacol.* 48:265-277). These patients are candidates for systemic therapy, which is administered following surgery in the adjuvant setting or as palliative therapy for those ineligible for surgery. For the past four decades, 5-fluorouracil (5-FU) has served as first-line therapy for the treatment of colorectal cancer. 5-FU is frequently used in combination with drugs such as leucovorin, which enhance the inhibition of thymidylate synthase by 5-FU treatment (Poon et al. (1991) *J. Clin. Oncol.* 9, 1967-1972). However, inhibition of thymidylate synthase alone is likely approaching a limit with respect to efficacy in colorectal cancer (Ragnhammer et al. (2001) *Acta Oncol* 40, 282-308). More recently, irninotecan (CPT-11) was proven beneficial for patients that has failed 5-FU-based therapies and was subsequently tested in combination therapy with 5-FU (Saltz et al. (2000) *N. Engl. J. Med.* 343, 905-914). 5-FU/leucovorin plus CPT-11 is now recommended as first-line therapy in advanced colorectal cancer.

The most common group of cancers among women in the United States is breast cancer, which is a complex disease, including several distinct subtypes, which differ in their pathology and respond differently to standard treatment. Several groups have conducted gene expression studies to classify various breast cancer types or predict clinical outcome (see, e.g. Golub et al. (1999) *Science* 286:531-537; Bhattacharjae et al. (2001) *Proc. Natl. Acad. Sci. USA* 98:13790-13795; Chen-Hsiang et al. (2001), *Bioinformatics* 17 (Suppl. 1):S316-S322; Ramaswamy et al. (2001) *Proc. Natl. Acad. Sci. USA* 98:15149-15154 (2001); Martin et al. (2000) *Cancer Res.* 60:2232-2238; West et al., (2001) *Proc. Natl. Acad. Sci. USA* 98:11462-11467); Sorlie et al., (2001) *Proc. Natl. Acad. Sci. USA* 98:10869-10874; Yan et al., *Cancer Res.* 61:8375-8380 (2001); Van De Vivjer et al. (2002), *New England Journal of Medicine* 347: 1999-2009; Ahr et al, (2002) Lancet 359:131-2; van't Veer et al. (2002) *Nature* 415:530-6; Dowsett and Ellis (2003) *Am. J. Clin. Oncol.* 25:S34-9). It has been reported that 5-FU treatment trascriptionally activates certain genes in breast cancer cell lines and 5-FU resistant colorectal cancer cell lines (Maxwell et al. (2003) *Cancer Res.* 63:4602-4606).

SUMMARY OF THE INVENTION

The present invention is, at least in part, based on the recognition that differences in gene expression between normal and cancer cells following exposure to standard care chemotherapeutics can be exploited to provide new combination therapies of cancer. For example, a cell surface antigen preferentially induced in cancer cells following drug treatment might serve as a target for an antagonist, such as, for example, a therapeutic antibody or a small molecule, used in combination with that drug. In addition, having an understanding of the genetic programs engaged by drug-treated cancer cells can provide new markers for efficacy and prognosis as well as further our understanding the mechanisms of drug action.

In one aspect, the invention concerns a method comprising administering to a subject diagnosed with a tumor an effective amount of a chemotherapeutic agent, and an antagonist of a gene product encoded by a gene the expression of which has been determined to be selectively upregulated in such tumor relative to corresponding normal cells by the chemotherapeutic agent.

In another aspect, the invention concerns a method for inhibiting the proliferation of tumor cells comprising:
  (a) confirming the presence of at least one gene that is selectively upregulated in said tumor cells relative to normal cells by a chemotherapeutic agent; and
  (b) treating said tumor cells with the chemotherapeutic agent and an antagonist of at least one of the selectively upregulated genes.

In yet another aspect, the invention concerns a therapeutic composition comprising an effective amount of a chemotherapeutic agent and an antagonist of a gene product encoded by a gene the expression of which is selectively upregulated in tumor cells relative to corresponding normal cells by the chemotherapeutic agent.

In a still further aspect, the invention concerns a prognostic method, comprising:
  (a) determining the expression level of one or more genes, or their expression products, before and after treatment with a chemotherapeutic agent, relative to corresponding normal cells, in a subject diagnosed with a tumor; and
  (b) identifying the subject as likely to respond well to combination treatment with the chemotherapeutic agent and an antagonist of a gene, the expression of which has been selectively induced by the chemotherapeutic agent.

In all aspects, the tumor is preferably cancer, such as, for example, breast cancer, colorectal cancer, lung cancer, prostate cancer, hepatocellular cancer, gastric cancer, pancreatic cancer, cervical cancer, ovarian cancer, liver cancer, bladder cancer, cancer of the urinary tract, thyroid cancer, renal cancer, carcinoma, melanoma, or brain cancer.

The chemotherapeutic agent can be any molecule currently used or developed in the future for the treatment of tumor, e.g. cancer. Chemotherapeutic agents include, without limitation, alkylating agents; alkyl sulfonates; aziridines; ethylenimines; methylamelamines; nitrogen mustards; nitrosureas; anti-metabolites; folic acid analogues; purine analogs; pyrimidine analogs, androgens; anti-adrenals; folic acid replenishers; aceglatone; aldophosphamide glycoside; aminolevulinic acid; amsacrine; bestrabucil; bisantrene; edatraxate; defofamine; demecolcine; diaziquone; elfornithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; PSK™; razoxane; sizofiran; spirogermanium; tenuazonic acid; triaziquone; 2,2', 2"-trichlorotriethylamine; urethan; vindesine; dacarbazine; mannomustine; mitobronitol; mitolactol; pipobroman; gacytosine; arabinoside ("Ara-C"); cyclophosphamide; thiotepa; taxanes; chlorambucil; gemcitabine; 6-thioguanine; mercaptopurine; methotrexate; platinum analogs; vinblastine; platinum; etoposide (VP-16); ifosfamide; mitomycin C; mitoxantrone; vincristine; vinorelbine; navelbine; novantrone; teniposide; daunomycin; aminopterin; xeloda; ibandronate; camptothecin-11 (CPT-11); topoisomerase inhibitor RFS 2000; difluoromethylornithine (DMFO); retinoic acid; esperamicins; capecitabine; anti-hormonal agents; and pharmaceutically acceptable salts, acids or derivatives thereof.

In all aspects, the preferred chemotherapeutic agent is CPT-11 or 5-FU.

In all aspects, antagonist include, for example, antibodies, peptides, non-peptide small organic molecules, antisense molecules, and oligonucleotide decoys, antibodies (including antibody fragments) and non-peptide small organic molecules being preferred. The antibody can be humanized (including chimeric antibodies), or human, for example. The antagonist cab bind to or otherwise interact with the gene product.

BRIEF DESCRIPTION OF THE DRAWINGS

Table I. Transcripts induced in Colo205 tumor xenografts exposed to CPT-11. Three tumor-bearing mice each were treated with CPT-11 or saline control and oligonucleotide microarray analysis was performed on all 6 RNA preparations. The fold change for transcripts in each CPT-11 treated sample relative to each control was calculated and the average fold change (Avg fold) for the nine possible comparisons is presented along with the percentage (% AGREE) of comparisons yielding a positive fold change. Table I discloses the Accession Numbers corresponding to SEQ ID NOS 26-68, respectively, in order of appearance.

Table II. Transcripts induced in the intestine f mice exposed to CPT-11. Three tumor-bearing mice each were treated with CPT-11 or saline control and oligonucleotide microarray analysis was performed on all 6 RNA preparations. The fold change for transcripts in each CPT-11 sample relative to each control was calculated and the average fold change (Ave fold) for the nine possible comparisons is presented along with the percentage (% AGREE) of comparisons yielding a positive fold change. Table II discloses the Accession Numbers corresponding to SEQ ID NOS 69-111, respectively, in order of appearance.

DETAILED DESCRIPTION OF THE PREFERRED EMBODIMENT

A. Definitions

Figure 1:
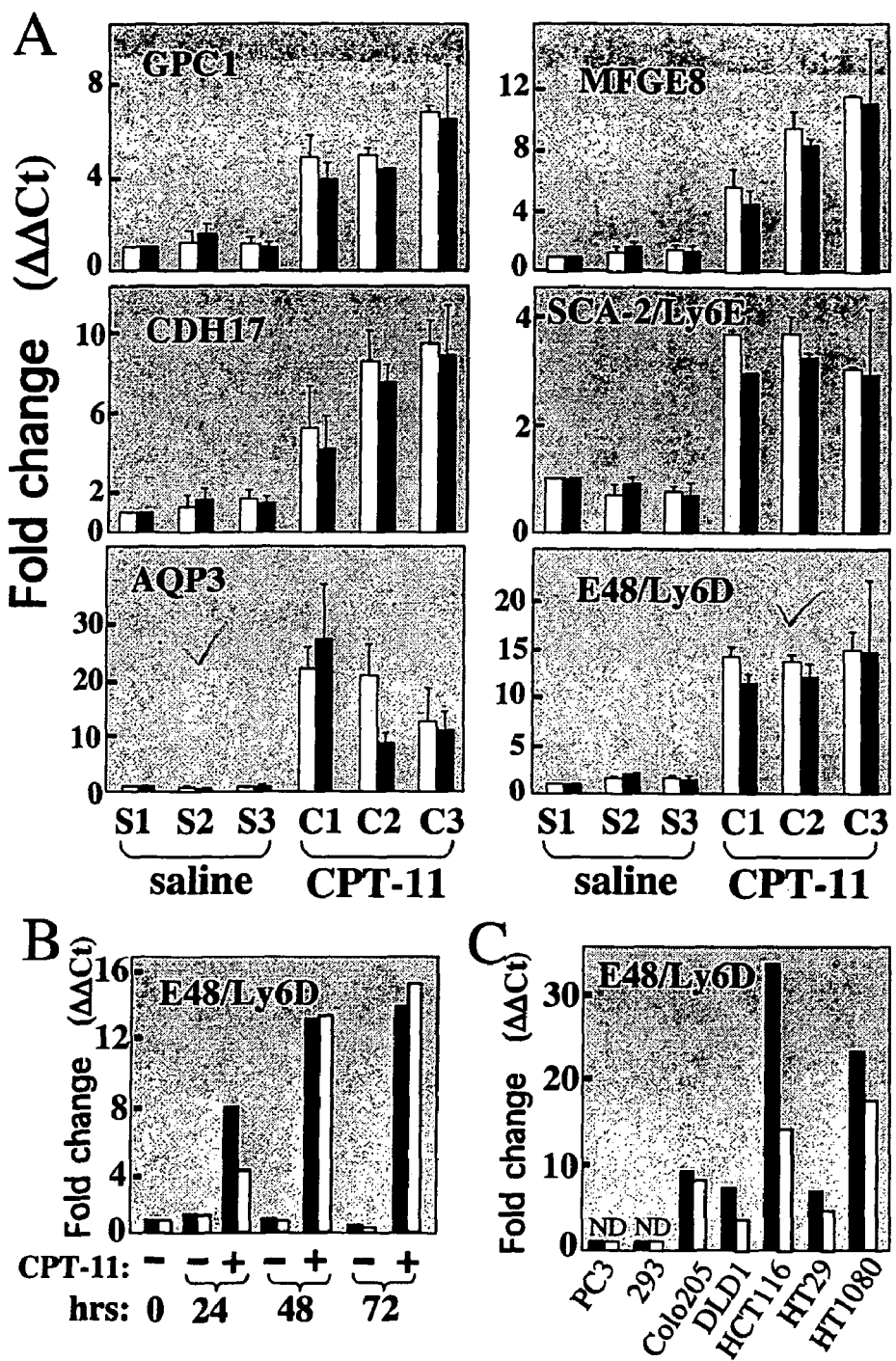
FIG. 1. mRNA transcripts coding for cell surface proteins induced by CPT-11 (Table I). A. Real-time PCR analysis of RNA from xenograft tumors grown in mice administered CPT-11 or saline. Relative amounts of the six transcripts were measured in three tumors from each group and plotted as fold change relative to S1, arbitrarily set to one. Cycle thresholds (Ct) were normalized to GAPDH (white bars) and Actine (black bars). B. Time course of LY6D/E48 mRNA induction following addition of 10 μM CPT-11 for 48 hours. Fold change is relative to vehicle control. Transcript was not detected (ND) in PC3 and 293 cell lines.

Unless defined otherwise, technical and scientific terms used herein have the same meaning as commonly understood by one of ordinary skill in the art to which this invention belongs. Singleton et al., Dictionary of Microbiology and Molecular Biology 2nd ed., J. Wiley & Sons (New York, N.Y. 1994), and March, Advanced Organic Chemistry Reactions, Mechanisms and Structure 4th ed., John Wiley & Sons (New York, N.Y. 1992), provide one skilled in the art with a general guide to many of the terms used in the present application.

One skilled in the art will recognize many methods and materials similar or equivalent to those described herein, which could be used in the practice of the present invention. Indeed, the present invention is in no way limited to the methods and materials described. For purposes of the present invention, the following terms are defined below.

The term "microarray" refers to an ordered arrangement of hybridizable array elements, preferably polynucleotide probes, on a substrate.

The term "polynucleotide," when used in singular or plural, generally refers to any polyribonucleotide or polydeoxribonucleotide, which may be unmodified RNA or DNA or modified RNA or DNA. Thus, for instance, polynucleotides as defined herein include, without limitation, single- and double-stranded DNA, DNA including single- and double-stranded regions, single- and double-stranded RNA, and RNA including single- and double-stranded regions, hybrid molecules comprising DNA and RNA that may be single-stranded or, more typically, double-stranded or include single- and double-stranded regions. In addition, the term "polynucleotide" as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. The term "polynucleotide" specifically includes cDNAs. The term includes DNAs (including cDNAs) and RNAs that contain one or more modified bases. Thus, DNAs or RNAs with backbones modified for stability or for other reasons are "polynucleotides" as that term is intended herein. Moreover, DNAs or RNAs comprising unusual bases, such as inosine, or modified bases, such as tritiated bases, are included within the term "polynucleotides" as defined herein. In general, the term "polynucleotide" embraces all chemically, enzymatically and/or metabolically modified forms of unmodified polynucleotides, as well as the chemical forms of DNA and RNA characteristic of viruses and cells, including simple and complex cells.

The term "oligonucleotide" refers to a relatively short polynucleotide, including, without limitation, single-stranded deoxyribonucleotides, single- or double-stranded ribonucleotides, RNA:DNA hybrids and double-stranded DNAs. Oligonucleotides, such as single-stranded DNA probe oligonucleotides, are often synthesized by chemical methods, for example using automated oligonucleotide synthesizers that are commercially available. However, oligonucleotides can be made by a variety of other methods, including in vitro recombinant DNA-mediated techniques and by expression of DNAs in cells and organisms.

The terms "differentially expressed gene," "differential gene expression" and their synonyms, which are used interchangeably, refer to a gene whose expression is activated to a higher or lower level in a subject suffering from a disease, specifically cancer, such as breast cancer, relative to its expression in a normal or control subject. The terms also include genes whose expression is higher or lower level at different stages of the same disease. The terms also include genes whose expression is higher or lower in patients who are significantly sensitive or resistant to certain therapeutic drugs. It is also understood that a differentially expressed gene may be either activated or inhibited at the nucleic acid level or protein level, or may be subject to alternative splicing to result in a different polypeptide product. Such differences may be evidenced by a change in MRNA levels, surface expression, secretion or other partitioning of a polypeptide, for example. Differential gene expression may include a comparison of expression between two or more genes or their gene products, or a comparison of the ratios of the expression between two or more genes or their gene products, or even a comparison of two differently processed products of the same gene, which differ between normal subjects and subjects suffering from a disease, specifically cancer, or between various stages of the same disease. Differential expression includes both quantitative, as well as qualitative, differences in the temporal or cellular expression pattern in a gene or its expression products among, for example, normal and diseased cells, or among cells which have undergone different disease events or disease stages, or cells that are significantly sensitive or resistant to certain therapeutic drugs For the purpose of this invention, "differential gene expression" is considered to be present when there is at least an about two-fold, preferably at least about four-fold, more preferably at least about six-fold, most preferably at least about ten-fold difference between the expression of a given gene in normal and diseased subjects, or in various stages of disease development in a diseased subject, or in patients who are differentially sensitive to certain therapeutic drugs.

The term "selectively upregulated" is used herein to refer to a gene that is induced by at least two-fold in a tumor by a given treatment whereas no significant induction is detected in corresponding normal tissue in the same treated subject.

The term "tumor," as used herein, refers to all neoplastic cell growth and proliferation, whether malignant or benign, and all pre-cancerous and cancerous cells and tissues.

The terms "cancer" and "cancerous" refer to or describe the physiological condition in mammals that is typically characterized by unregulated cell growth. Examples of cancer include but are not limited to, breast cancer, colon cancer, lung cancer, prostate cancer, hepatocellular cancer, gastric cancer, pancreatic cancer, cervical cancer, ovarian cancer, liver cancer, bladder cancer, cancer of the urinary tract, thyroid cancer, renal cancer, carcinoma, melanoma, and brain cancer.

The "pathology" of cancer includes all phenomena that compromise the well-being of the patient. This includes, without limitation, abnormal or uncontrollable cell growth, metastasis, interference with the normal functioning of neighboring cells, release of cytokines or other secretory products at abnormal levels, suppression or aggravation of inflammatory or immunological response, neoplasia, premalignancy, malignancy, invasion of surrounding or distant tissues or organs, such as lymph nodes, etc.

The term "treatment" refers to both therapeutic treatment and prophylactic or preventative measures, wherein the object is to prevent or slow down (lessen) the targeted pathologic condition or disorder. Those in need of treatment include those already with the disorder as well as those prone to have the disorder or those in whom the disorder is to be prevented. In tumor (e.g., cancer) treatment, a therapeutic agent may directly decrease the pathology of tumor cells, or render the tumor cells more susceptible to treatment by other therapeutic agents, e.g., radiation and/or chemotherapy.

A "chemotherapeutic agent" is a chemical compound useful in the treatment of cancer. Examples of chemotherapeutic agents include alkylating agents such as thiotepa and cyclosphosphamide (CYTOXAN™); alkyl sulfonates such as busulfan, improsulfan and piposulfan; aziridines such as benzodopa, carboquone, meturedopa, and uredopa; ethylenimines and methylamelamines including altretamine, triethylenemelamine, trietylenephosphoramide, triethylenethiophosphaoramide and trimethylolomelamine; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, ranimustine; antibiotics such as aclacinomysins, actinomycin, authramycin, azaserine, bleomycins, cactinomycin, calicheamicin, carabicin, carminomycin, carzinophilin, chromomycins, dactinomycin, daunorubicin, detorubicin, 6-diazo-5-oxo-L-norleucine, doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine, androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; amsacrine; bestrabucil; bisantrene; edatraxate; defofamine; demecolcine; diaziquone; elfomithine; elliptinium acetate; etoglucid; gallium nitrate; hydroxyurea; lentinan; lonidamine; mitoguazone; mitoxantrone; mopidamol; nitracrine; pentostatin; phenamet; pirarubicin; podophyllinic acid; 2-ethylhydrazide; procarbazine; PSK.R™; razoxane; sizofiran; spirogermanium; tenuazonic acid; triaziquone; 2,2',2"-trichlorotriethylamine; urethan; vindesine; dacarbazine; mannomustine; mitobronitol; mitolactol; pipobroman; gacytosine; arabinoside ("Ara-C"); cyclophosphamide; thiotepa; taxanes, e.g. paclitaxel (TAXOL™, Bristol-Myers Squibb Oncology, Princeton, N.J.) and docetaxel (TAXOTERE™, Rhone-Poulenc Rorer, Antony, France); chlorambucil; gemcitabine; 6-thioguanine; mercaptopurine; methotrexate; platinum analogs such as cisplatin and carboplatin; vinblastine; platinum; etoposide (VP-16); ifosfamide; mitomycin C; mitoxantrone; vincristine; vinorelbine; navelbine; novantrone; teniposide; daunomycin; aminopterin; xeloda; ibandronate; camptothecin-11 (CPT-11); topoisomerase inhibitor RFS 2000; difluoromethylornithine (DMFO); retinoic acid; esperamicins; capecitabine; and pharmaceutically acceptable salts, acids or derivatives of any of the above. Also included in this definition are anti-hormonal agents that act to regulate or inhibit hormone action on tumors such as anti-estrogens including for example tamoxifen, raloxifene, aromatase inhibiting 4(5)-imidazoles, 4-hydroxytamoxifen, trioxifene, keoxifene, LY 117018, onapristone, and toremifene (Fareston); and anti-androgens such as flutamide, nilutamide, bicalutamide, leuprolide, and goserelin; and pharmaceutically acceptable salts, acids or derivatives of any of the above.

A "growth inhibitory agent" when used herein refers to a compound or composition which inhibits growth of a tumor, such as a cancer, cell, either in vitro or in vivo. Thus, the growth inhibitory agent is one which significantly reduces the percentage of tumor cells in S phase. Examples of growth inhibitory agents include agents that block cell cycle progression (at a place other than S phase), such as agents that induce G1 arrest and M-phase arrest. Classical M-phase blockers include the vincas (vincristine and vinblastine), TAXOL™, and topo II inhibitors such as doxorubicin, epirubicin, daunorubicin, etoposide, and bleomycin. Those agents that arrest G1 also spill over into S-phase arrest, for example, DNA alkylating agents such as tamoxifen, prednisone, dacarbazine, mechlorethamine, cisplatin, methotrexate, 5-fluorouracil (5-FU), and ara-C. Further information can be found in The Molecular Basis of Cancer, Mendelsohn and Israel, eds., Chapter 1, entitled "Cell cycle regulation, oncogenes, and antineoplastic drugs" by Murakami et al. (W B Saunders: Philadelphia, 1995), especially p. 13.

"Neoadjuvant therapy" is adjunctive or adjuvant therapy given prior to the primary (main) therapy. Neoadjuvant therapy includes, for example, chemotherapy, radiation therapy, and hormone therapy. Thus, chemotherapy may be administered prior to surgery to shrink the tumor, so that surgery can be more effective, or, in the case of previously inoperable tumors, possible The term "front loading" when referring to drug administration is meant to describe an initially higher dose followed by the same or lower doses at intervals. The initial higher dose or doses are meant to more rapidly increase the animal or human patient's serum drug concentration to an efficacious target serum concentration. Front loading drug delivery includes delivery of initial and maintenance doses by infusion or bolus administration, intravenously or subcutaneously, for example.

"Antibodies" (Abs) and "immunoglobulins" (Igs) are glycoproteins having the same structural characteristics. While antibodies exhibit binding specificity to a specific antigen, immunoglobulins include both antibodies and other antibody-like molecules which lack antigen specificity. Polypeptides of the latter kind are, for example, produced at low levels by the lymph system and at increased levels by myelomas.

"Native antibodies" and "native immunoglobulins" are usually heterotetrameric glycoproteins of about 150,000 daltons, composed of two identical light (L) chains and two identical heavy (H) chains. Each light chain is linked to a heavy chain by one covalent disulfide bond, while the number of disulfide linkages varies among the heavy chains of different immunoglobulin isotypes. Each heavy and light chain also has regularly spaced intrachain disulfide bridges. Each heavy chain has at one end a variable domain ($V_H$) followed by a number of constant domains. Each light chain has a variable domain at one end ($V_L$) and a constant domain at its other end; the constant domain of the light chain is aligned with the first constant domain of the heavy chain, and the light-chain variable domain is aligned with the variable domain of the heavy chain. Particular amino acid residues are believed to form an interface between the light- and heavy-chain variable domains.

The term "variable" refers to the fact that certain portions of the variable domains differ extensively in sequence among antibodies and are used in the binding and specificity of each particular antibody for its particular antigen. However, the variability is not evenly distributed throughout the variable domains of antibodies. It is concentrated in three segments called complementarity determining regions (CDRs) or hypervariable regions both in the light-chain and the heavy-chain variable domains. The more highly conserved portions of variable domains are called the framework region (FR). The variable domains of native heavy and light chains each comprise four FR regions, largely adopting a .beta.-sheet configuration, connected by three CDRs, which form loops connecting, and in some cases forming part of, the β-sheet structure. The CDRs in each chain are held together in close proximity by the FRs and, with the CDRs from the other chain, contribute to the formation of the antigen-binding site of antibodies (see Kabat et al., NIH Publ. No. 91-3242, Vol. I, pages 647-669 [1991]). The constant domains involved directly in binding an antibody to an antigen, but exhibit various effector functions, such as participation of the antibody in antibody dependent cellular cytotoxicity.

Papain digestion of antibodies produces two identical antigen-binding fragments, called "Fab" fragments, each with a single antigen-binding site, and a residual "Fc" fragment, whose name reflects its ability to crystallize readily. Pepsin treatment yields an F(ab')$_2$ fragment that has two antigen-combining sites and is still capable of cross-linking antigen.

"Fv" is the minimum antibody fragment which contains a complete antigen-recognition and -binding site. This region consists of a dimer of one heavy- and one light-chain variable domain in tight, non-covalent association. It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment also contains the constant domain of the light chain and the first constant domain (CH1) of the heavy chain. Fab' fragments differ from Fab fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear a free thiol group. F(ab')$_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa (κ) and lambda (λ), based on the amino acid sequences of their constant domains. Depending on the amino acid sequence of the constant domain of their heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA, and IgA2. The heavy-chain constant domains that correspond to the different classes of immunoglobulins are called α, δ, ε, γ, and μ respectively. The subunit structures and three-dimensional configurations of different classes of immunoglobulins are well known.

The term "antibody" is used in the broadest sense and specifically covers intact monoclonal antibodies, polyclonal antibodies, multispecific antibodies (e.g. bispecific antibodies) formed from at least two intact antibodies, and antibody fragments so long as they exhibit the desired biological activity.

"Antibody fragments" comprise a portion of an intact antibody, preferably the antigen binding or variable region of the intact antibody. Examples of antibody fragments include Fab, Fab', F(ab')$_2$, and Fv fragments; diabodies; linear antibodies (Zapata et al., Protein Eng. 8(10): 1057-1062 [1995]); single-chain antibody molecules; and multispecific antibodies formed from antibody fragments.

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic site. Furthermore, in contrast to conventional (polyclonal) antibody preparations which typically include different antibodies directed against different determinants (epitopes), each monoclonal antibody is directed against a single determinant on the antigen. In addition to their specificity, the monoclonal antibodies are advantageous in that they are synthesized by the hybridoma culture, uncontaminated by other immunoglobulins. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler et al., Nature, 256:495 (1975), or may be made by recombinant DNA methods (see, e.g., U.S. Pat. No. 4,816,567). The "monoclonal antibodies" may also be isolated from phage antibody libraries using the techniques described in Clackson et al., Nature, 352:624-628 (1991) and Marks et al., J. Mol. Biol., 222:581-597 (1991), for example The monoclonal antibodies herein specifically include "chimeric" antibodies (immunoglobulins) in which portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (U.S. Pat. No. 4,816,567; Morrison et al., Proc. Natl. Acad. Sci. USA, 81:6851-6855 [1984]).

"Humanized" forms of non-human (e.g., murine) antibodies are chimeric immunoglobulins, immunoglobulin chains or fragments thereof (such as Fv, Fab, Fab', F(ab')$_2$ or other antigen-binding subsequences of antibodies) which contain minimal sequence derived from non-human immunoglobulin. For the most part, humanized antibodies are human immunoglobulins (recipient antibody) in which residues from a complementarity determining region (CDR) of the recipient are replaced by residues from a CDR of a non-human species (donor antibody) such as mouse, rat or rabbit having the desired specificity, affinity, and capacity. In some instances, framework region (FR) residues of the human immunoglobulin are replaced by corresponding non-human residues. Furthermore, humanized antibodies may comprise residues which are found neither in the recipient antibody nor in the imported CDR or framework sequences. These modifications are made to further refine and maximize antibody performance. In general, the humanized antibody will comprise substantially all of at least one, and typically two, variable domains, in which all or substantially all of the CDRs correspond to those of a non-human immunoglobulin and all or substantially all of the FRs are those of a human immunoglobulin sequence. The humanized antibody optimally also will comprise at least a portion of an immunoglobulin constant region (Fc), typically that of a human immunoglobulin. For further details, see Jones et al., Nature, 321:522-525 (1986); Reichmann et al., Nature, 332:323-329 (1988); and Presta, Curr. Op. Struct. Biol., 2:593-596 (1992). The humanized antibody includes a PRIMATIZED™ antibody wherein the antigen-binding region of the antibody is derived from an antibody produced by immunizing macaque monkeys with the antigen of interest.

"Single-chain Fv" or "sFv" antibody fragments comprise the $V_H$ and $V_L$ domains of antibody, wherein these domains are present in a single polypeptide chain. Preferably, the Fv polypeptide further comprises a polypeptide linker between the $V_H$ and $V_L$ domains which enables the sFv to form the desired structure for antigen binding. For a review of sFv see Pluckthun in The Pharmacology of Monoclonal Antibodies, vol. 113, Rosenburg and Moore eds., Springer-Verlag, New York, pp. 269-315 (1994).

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al., Proc. Natl. Acad. Sci. USA, 90:6444-6448 (1993).

An "isolated" antibody is one which has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

"Treatment" refers to both therapeutic treatment and prophylactic or preventative measures. Those in need of treatment include those already with the disorder as well as those in which the disorder is to be prevented.

"Mammal" for purposes of treatment refers to any animal classified as a mammal, including humans, higher primates, rodents, domestic and farm animals, and zoo, sports, or pet animals, such as dogs, horses, cats, cows, etc. Preferably, the mammal is human.

The term "antagonist" as used herein refers to a molecule having the ability to inhibit a biological function of a target polypeptide. Accordingly, the term "antagonist" is defined in the context of the biological role of the target polypeptide. While preferred antagonists herein specifically interact with (e.g. bind to) the target, molecules that inhibit a biological activity of the target polypeptide by interacting with other members of the signal transduction pathway of which the target polypeptide is a member are also specifically included within this definition. A preferred biological activity inhibited by an antagonist is associated with the development, growth, or spread of a tumor. Antagonists, as defined herein, without limitation, include antibodies, antibody fragments, peptides, non-peptide small molecules, antisense molecules, and oligonucleotide decoys.

B. Detailed Description

The practice of the present invention will employ, unless otherwise indicated, conventional techniques of molecular biology (including recombinant techniques), microbiology, cell biology, and biochemistry, which are within the skill of the art. Such techniques are explained fully in the literature, such as, "Molecular Cloning: A Laboratory Manual", 2nd edition (Sambrook et al., 1989); "Oligonucleotide Synthesis" (M. J. Gait, ed., 1984); "Animal Cell Culture" (R. I. Freshney, ed., 1987); "Methods in Enzymology" (Academic Press, Inc.); "Handbook of Experimental Immunology", 4th edition (D. M. Weir & C. C. Blackwell, eds., Blackwell Science Inc., 1987); "Gene Transfer Vectors for Mammalian Cells" (J. M. Miller & M. P. Calos, eds., 1987); "Current Protocols in Molecular Biology" (F. M. Ausubel et al., eds., 1987); and "PCR: The Polymerase Chain Reaction", (Mullis et al., eds., 1994).

Gene Expression Profiling Methods

The present invention takes advantage of the result of gene expression analysis, performed on tumor samples before and after treatment with a given chemotherapeutic agent, and on corresponding normal samples.

Methods of gene expression profiling include methods based on hybridization analysis of polynucleotides, methods based on sequencing of polynucleotides, and proteomics-based methods. The most commonly used methods known in the art for the quantification of mRNA expression in a sample include northern blotting and in situ hybridization (Parker & Bames, Methods in Molecular Biology 106:247-283 (1999)); RNAse protection assays (Hod, Biotechniques 13:852-854 (1992)); and PCR-based methods, such as reverse transcription polymerase chain reaction (RT-PCR) (Weis et al., Trends in Genetics 8:263-264 (1992)). Alternatively, antibodies may be employed that can recognize specific duplexes, including DNA duplexes, RNA duplexes, and DNA-RNA hybrid duplexes or DNA-protein duplexes. Representative methods for sequencing-based gene expression analysis include Serial Analysis of Gene Expression (SAGE), and gene expression analysis by massively parallel signature sequencing (MPSS).

Differential gene expression is often studied using microarray techniques. Thus, the expression profile of genes in tumor cells before and after treatment with a chemotherapeutic agents can be measured using microarray technology. In this method, polynucleotide sequences of interest (including cDNAs and oligonucleotides) are plated, or arrayed, on a microchip substrate. The arrayed sequences are then hybridized with specific DNA probes from cells or tissues of interest. The source of MRNA may, for example, be total RNA isolated from human tumors or tumor cell lines, and corresponding normal tissues or cell lines.

Microarrays may take different formats. Thus, for example cDNA (typically about 500-5,000 bases long) can be immobilized on a solid surface, such as glass, using robot spotting and exposed to a set of targets either separately or in a mixture. This method, "traditionally" called DNA microarray, is described, for example, in R. Ekins and F. W. Chu (1999) *Trends in Biotechnology*, 17:217-218.

In another format, an array of oligonucleotides (typically about 20-80-mer oligos) or peptide nucleic acid (PNA) probes is synthesized either in situ (on-chip) or by conventional synthesis followed by on-chip immobilization. The array is exposed to labeled sample DNA, hybridized, and the identity/abundance of complementary sequences are determined. This format, generally referred to as oligonucleotide microarray, is available from Affymetrix, which sells its photolithographically fabricated products under the GeneChip® trademark.

Another commonly used gene expression profiling method is reverse transcriptase PCR (RT-PCT). As RNA cannot serve as a template for PCR, the first step in gene expression profiling by RT-PCR is the reverse transcription of the RNA template into cDNA, followed by its exponential amplification in a PCR reaction. The two most commonly used reverse transcriptases are avilo myeloblastosis virus reverse transcriptase (AMV-RT) and Moloney murine leukemia virus reverse transcriptase (MMLV-RT). The reverse transcription step is typically primed using specific primers, random hexamers, or oligo-dT primers, depending on the circumstances and the goal of expression profiling.

Although the PCR step can use a variety of thermostable DNA-dependent DNA polymerases, it typically employs the Taq DNA polymerase, which has a 5'-3' nuclease activity but lacks a 3'-5' proofreading endonuclease activity. Thus, Taq-Man® PCR typically utilizes the 5'-nuclease activity of Taq or Tth polymerase to hydrolyze a hybridization probe bound to its target amplicon, but any enzyme with equivalent 5' nuclease activity can be used. Two oligonucleotide primers are used to generate an amplicon typical of a PCR reaction. A third oligonucleotide, or probe, is designed to detect nucleotide sequence located between the two PCR primers. The probe is non-extendible by Taq DNA polymerase enzyme, and is labeled with a reporter fluorescent dye and a quencher fluorescent dye. Any laser-induced emission from the reporter dye is quenched by the quenching dye when the two dyes are located close together as they are on the probe. During the amplification reaction, the Taq DNA polymerase enzyme cleaves the probe in a template-dependent manner. The resultant probe fragments disassociate in solution, and signal from the released reporter dye is free from the quenching effect of the second fluorophore. One molecule of reporter dye is liberated for each new molecule synthesized, and detection of the unquenched reporter dye provides the basis for quantitative interpretation of the data.

TaqMan® RT-PCR can be performed using commercially available equipment, such as, for example, ABI PRISM 7700™ Sequence Detection System™ (Perkin-Elmer-Applied Biosystems, Foster City, Calif., USA), or Lightcycler (Roche Molecular Biochemicals, Mannheim, Germany). 5'-Nuclease assay data are initially expressed as Ct, or the threshold cycle. As discussed above, fluorescence values are recorded during every cycle and represent the amount of product amplified to that point in the amplification reaction. The point when the fluorescent signal is first recorded as statistically significant is the threshold cycle (Ct). To minimize errors and the effect of sample-to-sample variation, RT-PCR is usually performed using an internal standard. The ideal internal standard is expressed at a relatively constant level among different tissues, and is unaffected by the experimental treatment. RNAs frequently used to normalize patterns of gene expression are mRNAs for the housekeeping genes glyceraldehyde-3-phosphate-dehydrogenase (GAPDH) and β-actin.

Real-time quantitative PCR measures PCR product accumulation through a dual-labeled fluorigenic probe (i.e., Taq-Man® probe). Real time PCR is compatible both with quantitative competitive PCR, where internal competitor for each target sequence is used for normalization, and with quantitative comparative PCR using a normalization gene contained within the sample, or a housekeeping gene for RT-PCR. For further details see, e.g. Held et al. (1996) Genome Research 6:986-994.

Other methods of gene expression profiling include, for example, the MassARRAY method developed by Sequenom, Inc. (San Diego, Calif.) (see, e.g. Ding and Cantor, (2003) Proc. Natl. Acad. Sci. USA 100:3059-3064); differential display (Liang and Pardee, (1992) Science 257:967-971); amplified fragment length polymorphism (iAFLP) (Kawamoto et al., (1999) Genome Res. 12:1305-1312); BeadArray™ technology (Illumina, San Diego, Calif.; Oliphant et al., Discovery of Markers for Disease (Supplement to Biotechniques), June 2002; Ferguson et al., (2000) Analytical Chemistry 72:5618); BeadsArray for Detection of Gene Expression (BADGE), using the commercially available Luminex100 LabMAP system and multiple color-coded microspheres (Luminex Corp., Austin, Tex.) in a rapid assay for gene expression (Yang et al., (2001) Genome Res. 11:1888-1898); and high coverage expression profiling (HiCEP) analysis (Fukumura et al., (2003) Nuc. Acids. Res. 31(16) e94).

Immunohistochemistry-based methods antibodies or antisera, preferably polyclonal antisera, and most preferably monoclonal antibodies specific for each marker are used to detect expression. The antibodies can be detected by direct labeling of the antibodies themselves, for example, with radioactive labels, fluorescent labels, hapten labels such as, biotin, or an enzyme such as horse radish peroxidase or alkaline phosphatase. Alternatively, unlabeled primary antibody is used in conjunction with a labeled secondary antibody, comprising antisera, polyclonal antisera or a monoclonal antibody specific for the primary antibody. Immunohistochemistry protocols and kits are well known in the art and are commercially available.

Since one purpose of the invention is the identification of cell surface molecules which are selectively activated in tumor cells when exposed to chemotherapeutic (e.g. cytotoxic) agents, proteomics methods, alone or in combination with gene expression analysis, are particularly suitable for monitoring such changes in polypeptide abundance. The term "proteome" is defined as the totality of the proteins present in a sample (e.g. tissue, organism, or cell culture) at a certain point of time. Proteomics includes, among other things, study of the global changes of protein expression in a sample (also referred to as "expression proteomics"). Proteomics typically includes the following steps: (1) separation of individual proteins in a sample by 2-D gel electrophoresis (2-D PAGE); (2) identification of the individual proteins recovered from the gel, e.g. my mass spectrometry or N-terminal sequencing, and (3) analysis of the data using bioinformatics. Proteomics methods are valuable supplements to other methods of gene expression profiling, and can be used, alone or in combination with other methods, to detect the cell surface molecules of the present invention.

Chemotherapy of cancer

The purpose of chemotherapeutic treatment of cancer is to cure the patient or, at least, slow down disease progression, increase survival, reduce the likelihood of cancer recurrence, control symptoms and/or maintain or improve quality of life. Chemotherapy varies depending on the type of cancer, and, in case of solid tumors, can be performed before and/or after surgical removal of primary tumor. For some cancers, there are a few universally accepted standard therapies, while the treatment of others is not yet standardized.

Exemplary chemotherapeutic agents have been listed before, and generally can be classified according to their mechanism of action. Some chemotherapeutic agents directly damage DNA and RNA. By disrupting replication of the DNA such chemotherapeutics either completely halt replication, or result in the production of nonsense DNA or RNA. This category includes, for example, cisplatin (Platinol®), daunorubicin (Cerubidine®), doxorubicin (Adriamycin®), and etoposide (VePesid®). Another group of cancer chemotherapeutic agents interfere with the formation of nucleotides or deoxyribonucleotides, so that RNA synthesis and cell replication is blocked. Examples of drugs in this class include methotrexate (Abitrexate®), mercaptopurine (Purinethol®), fluorouracil (Adrucil®), and hydroxyurea (Hydrea®). A third class of chemotherapeutic agents effects the synthesis or breakdown of mitotic spindles, and, as a result, interrupt cell division. Examples of drugs in this class include vinblastine (Velban®), vincristine (Oncovin®) and taxenes, such as, pacitaxel (Taxol®), and tocetaxel (Taxotere®). Other classifications, for example, based on the chemical structure of the chemotherapeutic agents, are also possible.

For breast cancer, doxorubicin (Adriamycin®) is considered by most the most effective single chemotherapeutic agent. In addition, 5-FU has been in clinical use for several decades, and is the cornerstone of many combination therapies for breast cancer. Other chemotherapeutic agents commonly used for the treatment of breast cancer include, for example, anthracyclines, taxane derivatives, and various combinations therapies, such as CMF (cyclophosphamide-methotrexate-fluorouracil) chemotherapy. Most patients receive chemotherapy immediately following surgical removal of tumor. This approach is commonly referred to as adjuvant therapy. However, chemotherapy can be administered also before surgery, as so called neoadjuvant treatment. Although the use of neo-adjuvant chemotherapy originates from the treatment of advanced and inoperable breast cancer, it has gained acceptance in the treatment of other types of cancers as well. The efficacy of neoadjuvant chemotherapy has been tested in several clinical trials. In the multi-center National Surgical Adjuvant Breast and Bowel Project B-18 (NSAB B-18) trial (Fisher et al., J. Clin. Oncology 15:2002-2004 (1997); Fisher et al., J. Clin. Oncology 16:2672-2685 (1998)) neoadjuvant therapy was performed with a combination of adriamycin and cyclophosphamide ("AC regimen"). In another clinical trial, neoadjuvant therapy was administered using a combination of 5-fluorouracil (5-FU), epirubicin and cyclophosphamide ("FEC regimen") (van Der Hage et al., J. Clin. Oncol. 19:4224-4237 (2001)). Other clinical trials have also used taxane-containing neoadjuvant treatment regiments. See, e.g. Holmes et al., J. Natl. Cancer Inst. 83:1797-1805 (1991) and Moliterni et al., Seminars in Oncology, 24:S17-10-S-17-14 (1999). For further information about neoadjuvant chemotherapy for breast cancer see, Cleator et al., Endocrine-Related Cancer 9:183-195 (2002).

5-FU, CPT-11 (irinotecan), and oxaliplatin, administered alone or in combination, have proven effective in the treatment of advanced colorectal cancer (CRC) (see, e.g. Grothey et al. (2004) J. Clin. Oncol. 22:1209-15).

Non-small-cell lung cancer (NSCLC) has been shown to respond well to combination therapy with vinorelbine, cisplatin and optionally paclitaxel (see, e.g. Rodriguez et al. (2004) Am. J. Clin. Oncol. 27:299-303).

Chemotherapeutic regimens for the treatment of other types of cancer are also well know to those skilled in the art.

The approach of the present invention is generally applicable to determine the effect of any of these treatments on the gene expression pattern of the tumor treated, which, in turn, enables the identification of antagonists that can lead to more effective combination therapies.

Antagonists

The first step in identifying antagonists of a target polypeptide, is typically in vitro screening to identify compounds that selectively bind the target polypeptide. Receptor-binding can be tested using target polypeptides isolated from their respective native sources, or produced by recombinant DNA technology and/or chemical synthesis. The binding affinity of the candidate compounds can be tested by direct binding (see, e.g. Schoemaker et al., J. Pharmacol. Exp. Ther., 285:61-69 (1983)) or by indirect, e.g. competitive, binding. In competitive binding experiments, the concentration of a compound necessary to displace 50% of another compound bound to the target polypeptide (IC50) is usually used as a measure of binding affinity. If the test compound binds the target selectively and with high affinity, displacing the first compound, it is identified as an antagonist. Cell based assays can be used in a similar manner.

A preferred group of antagonists includes antibodies specifically binding to the target polypeptide. Antibody "binding affinity" may be determined by equilibrium methods (e.g. enzyme-linked immunoabsorbent assay (ELISA) or radioimmunoassay (RIA)), or kinetics (e.g. BIACORE™ analysis), for example. Also, the antibody may be subjected to other "biological activity assays", e.g., in order to evaluate its "potency" or pharmacological activity and potential efficacy as a therapeutic agent. Such assays are known in the art and depend on the target antigen and intended use for the antibody.

Antibodies

Techniques for producing antibodies are well known in the art.

(1) Antibody Preparation (i) Antigen Preparation

Soluble antigens or fragments thereof, optionally conjugated to other molecules, can be used as immunogens for generating antibodies. For transmembrane molecules, such as receptors, fragments of these (e.g. the extracellular domain of a receptor) can be used as the immunogen. Alternatively, cells expressing the transmembrane molecule can be used as the immunogen. Such cells can be derived from a natural source (e.g. cancer cell lines) or may be cells which have been transformed by recombinant techniques to express the transmembrane molecule. Other antigens and forms thereof useful for preparing antibodies will be apparent to those in the art.

(ii) Polyclonal Antibodies

Polyclonal antibodies are preferably raised in animals by multiple subcutaneous (sc) or intraperitoneal (ip) injections of the relevant antigen and an adjuvant. It may be useful to conjugate the relevant antigen to a protein that is immunogenic in the species to be immunized, e.g., keyhole limpet hemocyanin, serum albumin, bovine thyroglobulin, or soybean trypsin inhibitor using a bifunctional or derivatizing agent, for example, maleimidobenzoyl sulfosuccinimide ester (conjugation through cysteine residues), N-hydroxysuccinimide (through lysine residues), glutaraldehyde, succinic anhydride, $SOCl_2$.

Animals are immunized against the antigen, immunogenic conjugates, or derivatives by combining, e.g., 100 μg or 5 μg of the protein or conjugate (for rabbits or mice, respectively) with 3 volumes of Freund's complete adjuvant and injecting the solution intradermally at multiple sites. One month later the animals are boosted with ⅕ to ⅒ the original amount of peptide or conjugate in Freund's complete adjuvant by subcutaneous injection at multiple sites. Seven to 14 days later the animals are bled and the serum is assayed for antibody titer. Animals are boosted until the titer plateaus. Preferably, the animal is boosted with the conjugate of the same antigen, but conjugated to a different protein and/or through a different cross-linking reagent. Conjugates also can be made in recombinant cell culture as protein fusions. Also, aggregating agents such as alum are suitably used to enhance the immune response.

(iii) Monoclonal Antibodies

Monoclonal antibodies may be made using the hybridoma method first described by Kohler et al., Nature, 256:495 (1975), or may be made by recombinant DNA methods (U.S. Pat. No. 4,816,567). In the hybridoma method, a mouse or other appropriate host animal, such as a hamster or macaque monkey, is immunized as hereinabove described to elicit lymphocytes that produce or are capable of producing antibodies that will specifically bind to the protein used for immunization. Alternatively, lymphocytes may be immunized in vitro. Lymphocytes then are fused with myeloma cells using a suitable fusing agent, such as polyethylene glycol, to form a hybridoma cell (Goding, Monoclonal Antibodies: Principles and Practice, pp. 59-103 (Academic Press, 1986)).

The hybridoma cells thus prepared are seeded and grown in a suitable culture medium that preferably contains one or more substances that inhibit the growth or survival of the unfused, parental myeloma cells. For example, if the parental myeloma cells lack the enzyme hypoxanthine guanine phosphoribosyl transferase (HGPRT or HPRT), the culture medium for the hybridomas typically will include hypoxanthine, aminopterin, and thymidine (HAT medium), which substances prevent the growth of HGPRT-deficient cells.

Preferred myeloma cells are those that fuse efficiently, support stable high-level production of antibody by the selected antibody-producing cells, and are sensitive to a medium such as HAT medium. Among these, preferred myeloma cell lines are murine myeloma lines, such as those derived from MOPC-21 and MPC-11 mouse tumors available from the Salk Institute Cell Distribution Center, San Diego, Calif. USA, and SP-2 or X63-Ag8-653 cells available from the American Type Culture Collection, Rockville, Md. USA. Human myeloma and mouse-human heteromyeloma cell lines also have been described for the production of human monoclonal antibodies (Kozbor, J. Immunol., 133:3001 (1984); Brodeur et al., Monoclonal Antibody Production Techniques and Applications, pp. 51-63 (Marcel Dekker, Inc., New York, 1987)).

Culture medium in which hybridoma cells are growing is assayed for production of monoclonal antibodies directed against the antigen. Preferably, the binding specificity of monoclonal antibodies produced by hybridoma cells is determined by immunoprecipitation or by an in vitro binding assay, such as radioimmunoassay (RIA) or enzyme-linked immunoabsorbent assay (ELISA).

After hybridoma cells are identified that produce antibodies of the desired specificity, affinity, and/or activity, the clones may be subcloned by limiting dilution procedures and grown by standard methods (Goding, Monoclonal Antibodies: Principles and Practice, pp. 59-103 (Academic Press, 1986)). Suitable culture media for this purpose include, for example, D-MEM or RPMI-1640 medium. In addition, the hybridoma cells may be grown in vivo as ascites tumors in an animal.

The monoclonal antibodies secreted by the subclones are suitably separated from the culture medium, ascites fluid, or serum by conventional immunoglobulin purification procedures such as, for example, protein A-Sepharose, hydroxylapatite chromatography, gel electrophoresis, dialysis, or affinity chromatography.

DNA encoding the monoclonal antibodies is readily isolated and sequenced using conventional procedures (e.g., by using oligonucleotide probes that are capable of binding specifically to genes encoding the heavy and light chains of the monoclonal antibodies). The hybridoma cells serve as a preferred source of such DNA. Once isolated, the DNA may be placed into expression vectors, which are then transfected into host cells such as *E. coli* cells, simian COS cells, Chinese Hamster Ovary (CHO) cells, or myeloma cells that do not otherwise produce immunoglobulin protein, to obtain the synthesis of monoclonal antibodies in the recombinant host cells. Recombinant production of antibodies will be described in more detail below.

In a further embodiment, antibodies or antibody fragments can be isolated from antibody phage libraries generated using the techniques described in McCafferty et al., Nature, 348: 552-554 (1990). Clackson et al., Nature, 352:624-628 (1991) and Marks et al., J. Mol. Biol., 222:581-597 (1991) describe the isolation of murine and human antibodies, respectively, using phage libraries. Subsequent publications describe the production of high affinity (nM range) human antibodies by chain shuffling (Marks et al., Bio/Technology, 10:779-783 (1992)), as well as combinatorial infection and in vivo recombination as a strategy for constructing very large phage libraries (Waterhouse et al., Nuc. Acids. Res., 21:2265-2266 (1993)). Thus, these techniques are viable alternatives to traditional monoclonal antibody hybridoma techniques for isolation of monoclonal antibodies.

The DNA also may be modified, for example, by substituting the coding sequence for human heavy- and light-chain constant domains in place of the homologous murine sequences (U.S. Pat. No. 4,816,567; Morrison, et al., Proc. Natl Acad. Sci. USA, 81:6851 (1984)), or by covalently joining to the immunoglobulin coding sequence all or part of the coding sequence for a non-immunoglobulin polypeptide.

Typically such non-immunoglobulin polypeptides are substituted for the constant domains of an antibody, or they are substituted for the variable domains of one antigen-combining site of an antibody to create a chimeric bivalent antibody comprising one antigen-combining site having specificity for an antigen and another antigen-combining site having specificity for a different antigen.

(iv) Humanized and Human Antibodies

A humanized antibody has one or more amino acid residues introduced into it from a source which is non-human. These non-human amino acid residues are often referred to as "import" residues, which are typically taken from an "import" variable domain. Humanization can be essentially performed following the method of Winter and co-workers (Jones et al., Nature, 321:522-525 (1986); Riechmann et al., Nature, 332:323-327 (1988); Verhoeyen et al., Science, 239: 1534-1536 (1988)), by substituting rodent CDRs or CDR sequences for the corresponding sequences of a human antibody. Accordingly, such "humanized" antibodies are chimeric antibodies (U.S. Pat. No. 4,816,567) wherein substantially less than an intact human variable domain has been substituted by the corresponding sequence from a non-human species. In practice, humanized antibodies are typically human antibodies in which some CDR residues and possibly some FR residues are substituted by residues from analogous sites in rodent antibodies.

The choice of human variable domains, both light and heavy, to be used in making the humanized antibodies is very important to reduce antigenicity. According to the so-called "best-fit" method, the sequence of the variable domain of a rodent antibody is screened against the entire library of known human variable domain sequences. The human sequence which is closest to that of the rodent is then accepted as the human FR for the humanized antibody (Sims et al., J. Immunol., 151:2296 (1993); Chothia et al., J. Mol. Biol., 196:901 (1987)). Another method uses a particular FR derived from the consensus sequence of all human antibodies of a particular subgroup of light or heavy chains. The same FR may be used for several different humanized antibodies (Carter et al., Proc. Natl. Acad. Sci. USA, 89:4285 (1992); Presta et al., J. Immunol., 151:2623 (1993)).

It is further important that antibodies be humanized with retention of high affinity for the antigen and other favorable biological properties. To achieve this goal, according to a preferred method, humanized antibodies are prepared by a process of analysis of the parental sequences and various conceptual humanized products using three-dimensional models of the parental and humanized sequences. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the recipient and import sequences so that the desired antibody characteristic, such as increased affinity for the target antigen(s), is achieved. In general, the CDR residues are directly and most substantially involved in influencing antigen binding.

Alternatively, it is now possible to produce transgenic animals (e.g., mice) that are capable, upon immunization, of producing a full repertoire of human antibodies in the absence of endogenous immunoglobulin production. For example, it has been described that the homozygous deletion of the antibody heavy-chain joining region (JH) gene in chimeric and germ-line mutant mice results in complete inhibition of endogenous antibody production. Transfer of the human germ-line immunoglobulin gene array in such germ-line mutant mice will result in the production of human antibodies upon antigen challenge. See, e.g., Jakobovits et al., Proc. Natl. Acad. Sci. USA, 90:2551 (1993); Jakobovits et al., Nature, 362:255-258 (1993); Bruggermann et al., Year in Immunol., 7:33 (1993); and Duchosal et al. Nature 355:258 (1992). Human antibodies can also be derived from phage-display libraries (Hoogenboom et al., J. Mol. Biol., 227:381 (1991); Marks et al., J. Mol. Biol., 222:581-597 (1991); Vaughan et al. Nature Biotech 14:309 (1996)).

(v) Antibody Fragments

Various techniques have been developed for the production of antibody fragments. Traditionally, these fragments were derived via proteolytic digestion of intact antibodies (see, e.g., Morimoto et al., Journal of Biochemical and Biophysical Methods 24:107-117 (1992) and Brennan et al., Science, 229:81 (1985)). However, these fragments can now be produced directly by recombinant host cells. For example, the antibody fragments can be isolated from the antibody phage libraries discussed above. Alternatively, Fab'-SH fragments can be directly recovered from E. coli and chemically coupled to form F(ab')$_2$ fragments (Carter et al., Bio/Technology 10:163-167 (1992)). According to another approach, F(ab')2 fragments can be isolated directly from recombinant host cell culture. Other techniques for the production of antibody fragments will be apparent to the skilled practitioner. In other embodiments, the antibody of choice is a single chain Fv fragment (scFv). See WO 93/16185.

(vi) Multispecific Antibodies

Multispecific antibodies have binding specificities for at least two different antigens. While such molecules normally will only bind two antigens (i.e. bispecific antibodies, BsAbs), antibodies with additional specificities such as trispecific antibodies are encompassed by this expression when used herein. Thus, bispecific antibodies binding to two cell surface molecules, the expression of which is upregulated by a chemotherapeutic agent, are specifically included.

Methods for making bispecific antibodies are known in the art. Traditional production of full length bispecific antibodies is based on the coexpression of two immunoglobulin heavy chain-light chain pairs, where the two chains have different specificities (Millstein et al., Nature, 305:537-539 (1983)). Because of the random assortment of immunoglobulin heavy and light chains, these hybridomas (quadromas) produce a potential mixture of 10 different antibody molecules, of which only one has the correct bispecific structure. Purification of the correct molecule, which is usually done by affinity chromatography steps, is rather cumbersome, and the product yields are low. Similar procedures are disclosed in WO 93/08829, and in Traunecker et al., EMBO J., 10:3655-3659 (1991).

According to a different approach, antibody variable domains with the desired binding specificities (antibody-antigen combining sites) are fused to immunoglobulin constant domain sequences. The fusion preferably is with an immunoglobulin heavy chain constant domain, comprising at least part of the hinge, CH2, and CH3 regions. It is preferred to have the first heavy-chain constant region (CH1) containing the site necessary for light chain binding, present in at least one of the fusions. DNAs encoding the immunoglobulin heavy chain fusions and, if desired, the immunoglobulin light chain, are inserted into separate expression vectors, and are co-transfected into a suitable host organism. This provides for great flexibility in adjusting the mutual proportions of the three polypeptide fragments in embodiments when unequal ratios of the three polypeptide chains used in the construction provide the optimum yields. It is, however, possible to insert the coding sequences for two or all three polypeptide chains in one expression vector when the expression of at least two polypeptide chains in equal ratios results in high yields or when the ratios are of no particular significance.

In a preferred embodiment of this approach, the bispecific antibodies are composed of a hybrid immunoglobulin heavy chain with a first binding specificity in one arm, and a hybrid immunoglobulin heavy chain-light chain pair (providing a second binding specificity) in the other arm. It was found that this asymmetric structure facilitates the separation of the desired bispecific compound from unwanted immunoglobulin chain combinations, as the presence of an immunoglobulin light chain in only one half of the bispecific molecule provides for a facile way of separation. This approach is disclosed in WO 94/04690. For further details of generating bispecific antibodies see, for example, Suresh et al., Methods in Enzymology, 121:210 (1986).

According to another approach described in WO96/27011, the interface between a pair of antibody molecules can be engineered to maximize the percentage of heterodimers which are recovered from recombinant cell culture. The preferred interface comprises at least a part of the CH3 domain of an antibody constant domain. In this method, one or more small amino acid side chains from the interface of the first antibody molecule are replaced with larger side chains (e.g. tyrosine or tryptophan). Compensatory "cavities" of identical or similar size to the large side chain(s) are created on the interface of the second antibody molecule by replacing large amino acid side chains with smaller ones (e.g. alanine or threonine). This provides a mechanism for increasing the yield of the heterodimer over other unwanted end-products such as homodimers.

Bispecific antibodies include cross-linked or "heteroconjugate" antibodies. For example, one of the antibodies in the heteroconjugate can be coupled to avidin, the other to biotin. Such antibodies have, for example, been proposed to target immune system cells to unwanted cells (U.S. Pat. No. 4,676, 980), and for treatment of HIV infection (WO 91/00360, WO 92/200373, and EP 03089). Heteroconjugate antibodies may be made using any convenient cross-linking methods. Suitable cross-linking agents are well known in the art, and are disclosed in U.S. Pat. No. 4,676,980, along with a number of cross-linking techniques.

Techniques for generating bispecific antibodies from antibody fragments have also been described in the literature. For example, bispecific antibodies can be prepared using chemical linkage. Brennan et al., Science, 229: 81 (1985) describe a procedure wherein intact antibodies are proteolytically cleaved to generate F(ab')$_2$ fragments. These fragments are reduced in the presence of the dithiol complexing agent sodium arsenite to stabilize vicinal dithiols and prevent intermolecular disulfide formation. The Fab' fragments generated are then converted to thionitrobenzoate (TNB) derivatives. One of the Fab'-TNB derivatives is then reconverted to the Fab'-thiol by reduction with mercaptoethylamine and is mixed with an equimolar amount of the other Fab'-TNB derivative to form the bispecific antibody. The bispecific antibodies produced can be used as agents for the selective immobilization of enzymes.

Recent progress has facilitated the direct recovery of Fab'-SH fragments from *E. coli*, which can be chemically coupled to form bispecific antibodies. Shalaby et al., J. Exp. Med., 175: 217-225 (1992) describe the production of a fully humanized bispecific antibody F(ab')$_2$ molecule. Each Fab' fragment was separately secreted from *E. coli* and subjected to directed chemical coupling in vitro to form the bispecific antibody. The bispecific antibody thus formed was able to bind to cells overexpressing the ErbB2 receptor and normal human T cells, as well as trigger the lytic activity of human cytotoxic lymphocytes against human breast tumor targets.

Various techniques for making and isolating bispecific antibody fragments directly from recombinant cell culture have also been described. For example, bispecific antibodies have been produced using leucine zippers. Kostelny et al., J. Immunol., 148(5):1547-1553 (1992). The leucine zipper peptides from the Fos and Jun proteins were linked to the Fab' portions of two different antibodies by gene fusion. The antibody homodimers were reduced at the hinge region to form monomers and then re-oxidized to form the antibody heterodimers. This method can also be utilized for the production of antibody homodimers. The "diabody" technology described by Hollinger et al., Proc. Natl. Acad. Sci. USA, 90:6444-6448 (1993) has provided an alternative mechanism for making bispecific antibody fragments. The fragments comprise a heavy-chain variable domain ($V_H$) connected to a light-chain variable domain ($V_L$) by a linker which is too short to allow pairing between the two domains on the same chain. Accordingly, the $V_H$ and $V_L$ domains of one fragment are forced to pair with the complementary $V_L$ and $V_H$ domains of another fragment, thereby forming two antigen-binding sites. Another strategy for making bispecific antibody fragments by the use of single-chain Fv (sFv) dimers has also been reported. See Gruber et al., J. Immunol., 152:5368 (1994).

Antibodies with more than two valencies are contemplated. For example, trispecific antibodies can be prepared. Tutt et al. J. Immunol. 147: 60 (1991).

(vii) Effector Function Engineering

It may be desirable to modify the antibody of the invention with respect to effector function, so as to enhance the effectiveness of the antibody in treating cancer, for example. For example cysteine residue(s) may be introduced in the Fc region, thereby allowing interchain disulfide bond formation in this region. The homodimeric antibody thus generated may have improved internalization capability and/or increased complement-mediated cell killing and antibody-dependent cellular cytotoxicity (ADCC). See Caron et al., J. Exp Med. 176:1191-1195 (1992) and Shopes, B. J. Immunol. 148:2918-2922 (1992). Homodimeric antibodies with enhanced antitumor activity may also be prepared using heterobifunctional cross-linkers as described in Wolff et al. Cancer Research 53:2560-2565 (1993). Alternatively, an antibody can be engineered which has dual Fc regions and may thereby have enhanced complement lysis and ADCC capabilities. See Stevenson et al. Anti-Cancer Drug Design 3:219-230 (1989).

(viii) Immunoconjugates

The invention also pertains to immunoconjugates comprising the antibody described herein conjugated to a cytotoxic agent such as a chemotherapeutic agent, toxin (e.g. an enzymatically active toxin of bacterial, fungal, plant or animal origin, or fragments thereof), or a radioactive isotope (i.e., a radioconjugate).

Chemotherapeutic agents useful in the generation of such immunoconjugates have been described above. Enzymatically active toxins and fragments thereof which can be used include diphtheria A chain, nonbinding active fragments of diphtheria toxin, exotoxin A chain (from Pseudomonas aeruginosa), ricin A chain, abrin A chain, modeccin A chain, alpha-sarcin, Aleurites fordii proteins, dianthin proteins, Phytolaca americana proteins (PAPI, PAPII, and PAP-S), momordica charantia inhibitor, curcin, crotin, sapaonaria officinalis inhibitor, gelonin, mitogellin, restrictocin, phenomycin, enomycin and the tricothecenes. A variety of radionuclides are available for the production of radioconjugate antibodies. Examples include $^{212}$Bi, $^{133}$I, $^{131}$In, $^{90}$Y and $^{186}$Re.

Conjugates of the antibody and cytotoxic agent are made using a variety of bifunctional protein coupling agents such as N-succinimidyl-3-(2-pyridyldithiol)propionate (SPDP), iminothiolane (IT), bifunctional derivatives of imidoesters (such as dimethyl adipimidate HCL), active esters (such as disuccinimidyl suberate), aldehydes (such as glutareldehyde), bis-azido compounds (such as bis (p-azidobenzoyl)hexanediamine), bis-diazonium derivatives (such as bis-(p-diazoniumbenzoyl)-ethylenediamine), diisocyanates (such as tolyene 2,6-diisocyanate), and bis-active fluorine compounds (such as 1,5-difluoro-2,4-dinitrobenzene). For example, a ricin immunotoxin can be prepared as described in Vitetta et al. Science 238: 1098 (1987). Carbon-14-labeled 1 -isothiocyanatobenzyl-3-methyldiethylene triaminepentaacetic acid (MX-DTPA) is an exemplary chelating agent for conjugation of radionucleotide to the antibody. See WO94/ 11026.

In another embodiment, the antibody may be conjugated to a "receptor" (such streptavidin) for utilization in tumor pretargeting wherein the antibody-receptor conjugate is administered to the patient, followed by removal of unbound conjugate from the circulation using a clearing agent and then administration of a "ligand" (e.g. avidin) which is conjugated to a cytotoxic agent (e.g. a radionucleotide).

(ix) Immunoliposomes

The antibodies may also be formulated as immunoliposomes. Liposomes containing the antibody are prepared by methods known in the art, such as described in Epstein et al., Proc. Natl. Acad. Sci. USA, 82:3688 (1985); Hwang et al., Proc. Natl Acad. Sci. USA, 77:4030 (1980); and U.S. Pat. Nos. 4,485,045 and 4,544,545. Liposomes with enhanced circulation time are disclosed in U.S. Pat. No. 5,013,556.

Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al. J. Biol. Chem. 257: 286-288 (1982) via a disulfide interchange reaction. A chemotherapeutic agent (such as Doxorubicin) is optionally contained within the liposome. See Gabizon et al. J. National Cancer Inst.81(19)1484 (1989).

(x) Antibody Dependent Enzyme Mediated Prodrug Therapy (ADEPT)

The antibodies of the present invention may also be used in ADEPT by conjugating the antibody to a prodrug-activating enzyme which converts a prodrug (e.g. a peptidyl chemotherapeutic agent, see WO81/01145) to an active anti-cancer drug. See, for example, WO 88/07378 and U.S. Pat. No. 4,975,278.

The enzyme component of the immunoconjugate useful for ADEPT includes any enzyme capable of acting on a prodrug in such a way so as to covert it into its more active, cytotoxic form.

Enzymes that are useful in the method of this invention include, but are not limited to, alkaline phosphatase useful for converting phosphate-containing prodrugs into free drugs; arylsulfatase useful for converting sulfate-containing prodrugs into free drugs; cytosine deaminase useful for converting non-toxic 5-fluorocytosine into the anti-cancer drug, 5-fluorouracil; proteases, such as serratia protease, thermolysin, subtilisin, carboxypeptidases and cathepsins (such as cathepsins B and L), that are useful for converting peptide-containing prodrugs into free drugs; D-alanylcarboxypeptidases, useful for converting prodrugs that contain D-amino acid substituents; carbohydrate-cleaving enzymes such as beta-galactosidase and neuraminidase useful for converting glycosylated prodrugs into free drugs; beta-lactamase useful for converting drugs derivatized with beta-lactams into free drugs; and penicillin amidases, such as penicillin V amidase or penicillin G amidase, useful for converting drugs derivatized at their amine nitrogens with phenoxyacetyl or phenylacetyl groups, respectively, into free drugs. Alternatively, antibodies with enzymatic activity, also known in the art as "abzymes", can be used to convert the prodrugs of the invention into free active drugs (see, e.g., Massey, Nature 328: 457-458 (1987)). Antibody-abzyme conjugates can be prepared as described herein for delivery of the abzyme to a tumor cell population.

(xi) Antibody-salvage Receptor Binding Epitope Fusions.

In certain embodiments of the invention, it may be desirable to use an antibody fragment, rather than an intact antibody, to increase tumor penetration, for example. In this case, it may be desirable to modify the antibody fragment in order to increase its serum half life. This may be achieved, for example, by incorporation of a salvage receptor binding epitope into the antibody fragment (e.g. by mutation of the appropriate region in the antibody fragment or by incorporating the epitope into a peptide tag that is then fused to the antibody fragment at either end or in the middle, e.g., by DNA or peptide synthesis).

The salvage receptor binding epitope preferably constitutes a region wherein any one or more amino acid residues from one or two loops of a Fc domain are transferred to an analogous position of the antibody fragment. Even more preferably, three or more residues from one or two loops of the Fc domain are transferred. Still more preferred, the epitope is taken from the CH2 domain of the Fc region (e.g., of an IgG) and transferred to the CH1, CH3, or $V_H$ region, or more than one such region, of the antibody. Alternatively, the epitope is taken from the CH2 domain of the Fc region and transferred to the $C_L$ region or $V_L$ region, or both, of the antibody fragment. See, e.g., U.S. Pat. 5,739,277, issued Apr. 14, 1998.

(xii) Covalent Modifications

Covalent modifications of the antibody are included within the scope of this invention. They may be made by chemical synthesis or by enzymatic or chemical cleavage of the antibody, if applicable. Other types of covalent modifications of the antibody are introduced into the molecule by reacting targeted amino acid residues of the antibody with an organic derivatizing agent that is capable of reacting with selected side chains or the N- or C-terminal residues.

Removal of any carbohydrate moieties present on the antibody may be accomplished chemically or enzymatically. Chemical deglycosylation requires exposure of the antibody to the compound trifluoromethanesulfonic acid, or an equivalent compound. This treatment results in the cleavage of most or all sugars except the linking sugar (N-acetylglucosamine or N-acetylgalactosamine), while leaving the antibody intact. Chemical deglycosylation is described by Hakimuddin, et al. Arch. Biochem. Biophys. 259:52 (1987) and by Edge et al. Anal. Biochem., 118:131 (1981). Enzymatic cleavage of carbohydrate moieties on antibodies can be achieved by the use of a variety of endo- and exo-glycosidases as described by Thotakura et al. Meth. Enzymol. 138:350 (1987).

Another type of covalent modification of the antibody comprises linking the antibody to one of a variety of nonproteinaceous polymers, e.g., polyethylene glycol, polypropylene glycol, or polyoxyalkylenes, in the manner set forth in U.S. Pat. Nos. 4,640,835; 4,496,689; 4,301,144; 4,670,417; 4,791,192 or 4,179,337.

(2) Recombinant Production of Antibodies

The antibodies of the present invention can be made, for example, by techniques of recombinant DNA technology.

Suitable host cells for cloning or expressing the DNA in the vectors herein are the prokaryote, yeast, or higher eukaryote cells described above. Suitable prokaryotes for this purpose include eubacteria, such as Gram-negative or Gram-positive organisms, for example, *Enterobacteriaceae* such as *Escherichia*, e.g., *E. coli*, *Enterobacter, Erwinia, Klebsiella, Proteus, Salmonella*, e.g., *Salmonella typhimurium, Serratia*, e.g., *Serratia marcescans*, and *Shigella*, as well as *Bacilli* such as *B. subtilis* and *B. licheniformis* (e.g., *B. licheniformis* 41P disclosed in DD 266,710 published Apr. 12, 1989), *Pseudomonas* such as *P. aeruginosa*, and *Streptomyces*. One preferred *E. coli* cloning host is *E. coli* 294 (ATCC 31,446), although other strains such as *E. coli* B, *E. coli* X1776 (ATCC 31,537), and *E. coli* W3110 (ATCC 27,325) are suitable. These examples are illustrative rather than limiting.

In addition to prokaryotes, eukaryotic microbes such as filamentous fungi or yeast are suitable cloning or expression hosts for antibody-encoding vectors. *Saccharomyces cerevisiae*, or common baker's yeast, is the most commonly used among lower eukaryotic host microorganisms. However, a number of other genera, species, and strains are commonly available and useful herein, such as *Schizosaccharomyces pombe; Kluyveromyces* hosts such as, e.g., *K. lactis, K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906), *K. thermotolerans*, and *K. marxianus; yarrowia* (EP 402,226); *Pichia pastoris* (EP 183, 070); *Candida; Trichoderma reesia* (EP 244,234); *Neurospora crassa; Schwanniomyces* such as *Schwanniomyces occidentalis*; and filamentous fungi such as, e.g., *Neurospora, Penicillium, Tolypocladium*, and *Aspergillus* hosts such as *A. nidulans* and *A. niger.*

Suitable host cells for the expression of glycosylated antibody are derived from multicellular organisms. Examples of invertebrate cells include plant and insect cells. Numerous baculoviral strains and variants and corresponding permissive insect host cells from hosts such as *Spodoptera frugiperda* (caterpillar), *Aedes aegypti* (mosquito), *Aedes albopictus* (mosquito), *Drosophila melanogaster* (fruitfly), and *Bombyx mori* have been identified. A variety of viral strains for transfection are publicly available, e.g., the L-1 variant of Autographa californica NPV and the Bm-5 strain of *Bombyx mori* NPV, and such viruses may be used as the virus herein according to the present invention, particularly for transfection of *Spodoptera frugiperda* cells. Plant cell cultures of cotton, corn, potato, soybean, petunia, tomato, and tobacco can also be utilized as hosts.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36:59 (1977)); baby hamster kidney cells (BHK, ATCC CCL 10); Chinese hamster ovary cells/-DHFR (CHO, Urlaub et al., Proc. Natl. Acad. Sci. USA 77:4216 (1980)); mouse sertoli cells (TM4, Mather, Biol. Reprod. 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., Annals N.Y. Acad. Sci. 383:44-68 (1982)); MRC 5 cells; FS4 cells; and a human hepatoma line (Hep G2).

Host cells are transformed with expression or cloning vectors, which are well known in the art, for antibody production and cultured in conventional nutrient media modified as appropriate for inducing promoters, selecting transformants, or amplifying the genes encoding the desired sequences.

The host cells used to produce the antibodies of this invention may be cultured in a variety of media. Commercially available media such as Ham's F10 (Sigma), Minimal Essential Medium ((MEM), (Sigma), RPMI-1640 (Sigma), and Dulbecco's Modified Eagle's Medium ((DMEM), Sigma) are suitable for culturing the host cells. In addition, any of the media described in Ham et al., Meth. Enz. 58:44 (1979), Barnes et al., Anal. Biochem. 102:255 (1980), U.S. Pat. Nos. 4,767,704; 4,657,866; 4,927,762; 4,560,655; or 5,122,469; WO 90/03430; WO 87/00195; or U.S. Pat. Re. 30,985 may be used as culture media for the host cells. Any of these media may be supplemented as necessary with hormones and/or other growth factors (such as insulin, transferrin, or epidermal growth factor), salts (such as sodium chloride, calcium, magnesium, and phosphate), buffers (such as HEPES), nucleotides (such as adenosine and thymidine), antibiotics (such as GENTAMYCIN™ drug), trace elements (defined as inorganic compounds usually present at final concentrations in the micromolar range), and glucose or an equivalent energy source. Any other necessary supplements may also be included at appropriate concentrations that would be known to those skilled in the art. The culture conditions, such as temperature, pH, and the like, are those previously used with the host cell selected for expression, and will be apparent to the ordinarily skilled artisan.

When using recombinant techniques, the antibodies can be produced intracellularly, in the periplasmic space, or directly secreted into the medium. If the antibody is produced intracellularly, as a first step, the particulate debris, either host cells or lysed fragments, is removed, for example, by centrifugation or ultrafiltration. Carter et al., Bio/Technology 10:163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody composition prepared from the cells can be purified using, for example, hydroxylapatite chromatography, gel electrophoresis, dialysis, and affinity chromatography, with affinity chromatography being the preferred purification technique. The suitability of protein A as an affinity ligand depends on the species and isotype of any immunoglobulin Fc domain that is present in the antibody. Protein A can be used to purify antibodies that are based on human γ1, γ2, or γ4 heavy chains (Lindmark et al., J. Immunol. Meth. 62:1-13 (1983)). Protein G is recommended for all mouse isotypes and for human γ3 (Guss et al., EMBO J. 5:15671575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the antibody comprises a CH3 domain, the Bakerbond ABX™ resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the antibody variant to be recovered.

Pharmaceutical Formulations

The chemotherapeutic agents herein are typically administered following dosages and routes of administration used in current clinical practice. For example, 5-fluorouracil (5-FU, Adrucil®) is in clinical use for the treatment of breast cancer, gastrointestinal cancers, including anal, esophageal, pancreas and gastric cancers, head and neck cancer, liver cancer, and ovarian cancer, and is typically administered as an i.v. bolus injection or continuous infusion. The amount of time and schedule varies depending on the type and stage of cancer, the treatment history and overall condition of patient, and other factors typically considered by practicing physicians. For administration as a continuous infusion, a typical dosing schedule is a weekly continuous infusion at 1,300 mg/m², which may be modified during treatment.

The antineoplastic agent irinotecan hydrochloride trihydrate (CPT-11, Camptosar, PNU-101440E; (S)-[1,4'-bipiperidine]-1'-carboxylic acid, 4,11-diethyl-3,4,12,14-tetrahydro-4-hydroxy-3,14-dioxo-1H-pyrano[3',4':6,7]indolizino (1,2-b)quinolin-9-yl ester, monohydrochloride, trihydrate; $C_{33}H_{38}N_4O_6 \cdot HCl \cdot 3H_2O$) is a semisynthetic derivative of the natural product camptothecin (Kunimoto et al. (1987) *Cancer Res.* 47:5944-5947; Sawada et al. (1991) *Chem. Pharm. Bull.* 39:1446-1454). CPT-11 has been approved by the U.S. Food and Drug Administration for the treatment of patients with metastatic carcinoma of the colon or rectum whose disease has recurred or progressed following 5-fluorouracil-based therapy. The recommended starting dosage of CPT-11 is either 125 mg/m² i.v. over 90 min once a week for 4 weeks, followed by a 2-week rest, or 350 mg/m² given once every 3 weeks. Dosage modifications after the initial dose are based on individual patient tolerance.

Formulations, dosages and treatment protocols used to administer the antagonists of the present invention will vary depending on the specific antagonist, the type and stage of cancer, and other factors typically considered in clinical practice, and can be readily determined by those skilled in the art. If the antagonist is an antibody, therapeutic formulations are prepared for storage by mixing the antibody having the desired degree of purity with optional physiologically acceptable carriers, excipients or stabilizers (Remington's Pharmaceutical Sciences 16th edition, Osol, A. Ed. (1980)), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptide; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

The formulation may also contain more than one active compound as necessary for the particular indication being treated, preferably those with complementary activities that do not adversely affect each other. For example, it may be desirable to further provide an immunosuppressive agent. Such molecules are suitably present in combination in amounts that are effective for the purpose intended.

The active ingredients may also be entrapped in microcapsule prepared, for example, by coacervation techniques or by interfacial polymerization, for example, hydroxymethylcellulose or gelatin-microcapsule and poly-(methylmethacylate) microcapsule, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

The formulations to be used for in vivo administration must be sterile. This is readily accomplished by filtration through sterile filtration membranes.

Sustained-release preparations may be prepared. Suitable examples of sustained-release preparations include semipermeable matrices of solid hydrophobic polymers containing the antibody variant, which matrices are in the form of shaped articles, e.g., films, or microcapsule. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods. When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

The formulation is administered to a mammal in need of treatment with the antibody, preferably a human, in accord with known methods, such as intravenous administration as a bolus or by continuous infusion over a period of time, by intramuscular, intraperitoneal, intracerobrospinal, subcutaneous, intra-articular, intrasynovial, intrathecal, oral, topical, or inhalation routes. In preferred embodiments, the formulation is administered to the mammal by intravenous administration. For such purposes, the formulation may be injected using a syringe or via an IV line, for example.

The appropriate dosage ("therapeutically effective amount") of the antibody will depend, for example, on the condition to be treated, the severity and course of the condition, whether the antibody is administered for preventive or therapeutic purposes, previous therapy, the patient's clinical history and response to the antibody, the type of antibody used, and the discretion of the attending physician. The antibody is suitably administered to the patent at one time or over a series of treatments and may be administered to the patent at any time from diagnosis onwards. The antibody may be administered as the sole treatment or in conjunction with other drugs or therapies useful in treating the condition in question.

As a general proposition, the therapeutically effective amount of the antibody administered will be in the range of about 0.1 to about 50 mg/kg of patent body weight whether by one or more administrations, with the typical range of antibody used being about 0.3 to about 20 mg/kg, more preferably about 0.3 to about 15 mg/kg, administered daily, for example. However, other dosage regimens may be useful. The progress of this therapy is easily monitored by conventional techniques.

The present invention also includes therapeutic mixtures of one or more chemotherapeutic agents and one or more antagonists of a gene or genes that are selectively upregulated by such chemotherapeutic agent(s). Formulations comprising such therapeutic mixtures can be prepared using methods and ingredients known in the art, such as those discussed above. Similarly, dosages are expected to be within the ranges discussed above, although in a combination the effective doses of the active ingredients may be lower than the dosage for the same active ingredient when used alone.

Administration "in combination" includes administration as a mixture, simultaneous administration using separate formulations, and consecutive administration in any order.

The methods of the present invention may be combined with other treatment options, including surgical procedures, radiation, and/or the administration of any type of anti-cancer agent.

Further details of the invention are illustrated by the following non-limiting Example.

EXAMPLE

Treatment of Human Colorectal Tumor Xenografts with Irinotecan (CPT-11) Activates Genes Normally Expressed by Squamous Cell Epithelium This study was designed to identify gene transcripts acutely expressed by human colorectal adenocarcinomas following in vivo exposure to the standard care chemotherapeutic irinotecan. Colo205 and DLD-1 xenografts were used as p53 wild-type (wt) and p53 mutant tumor models, respectively, and gene expression by normal murine colon tissue resected from the same animals was also analyzed. The expression levels of numerous transcripts were reproducibly altered by drug treatment of the tumors, including, but not limited to, the genes normally expressed by squamous cell epithelium.

Materials and Methods

Cell lines-Colo205, HCT116, HT29 (ATCC Nos. CCL222, CCL221, CCL247, HTB38, respectively) are human colorectal adenocarcinoma cell lines. 293 is a human immortalized embryonic kidney cell line (ATCC CRL573). PC-3 is a human prostate adenocarcinoma cell line (ATCC CRL1435) and HT1080 is a human fibrosarcoma cell line (ATCC CCL-121). PC-3 stable cell lines were generated by transfection (Effectene, Qiagen) with a CMV-driven vector encoding either an NH2-terminal gD epitope-tagged form of LY6D/E48 or an empty vector and selected in 400 µg/ml G418 (Geneticin, Life Technologies, Inc.). Growth conditions were according to American Type Culture Collection (ATCC, Manassas, Va.) guidelines. For all cell lines, CPT11 treatments were done in 10 cm dishes for the indicated timepoints. Cells were harvested and RNA was prepared using RNeasy kit (Qiagen, Hilden, Germany). TaqMan® real-time quantitative PCR analysis was performed as described below.

Growth and treatment of human tumor xenografts—Female nude mice (Charles River Laboratories, Hollister Calif.) were maintained in accordance with the guide for the Care and Use of Laboratory Animals, Colo205 human colorectal cancer cells were harvested, resuspended in HBSS, and injected s.c. into flanks (5×10$^6$ cells/flank) of 6-8 week old mice. Tumors were allowed to grow for two weeks at which time 0.1 ml of CPT-11 (80 mg/kg mouse) or 0.1 ml of saline control was administered intraperitoneally (IP) to each animal three consecutive times at 4 day intervals. Twenty-four hours following the final dose of CPT-11 or saline, tumors were resected from the animals. Three tumors from CPT-11 treated animals with masses of 0.23, 0.18, and 0.50 grams, and three from the saline controls with masses of 0.23, 0.36 and 0.38 grams were each divided in half. Half of each tumor was frozen immediately in liquid nitrogen for subsequent extraction of RNA and the other half was fixed in 10% neutral buffer formalin overnight and then transferred 24 hours later into 70% ethanol for sectioning, microscopic analysis and analysis by in situ hybridization. Tumor xenografts of the DLD-1 colorectal cell line were treated and prepared in essentially the same manner. The masses of the DLD-1 colorectal tumor xenografts at time of resection were 0.24, 0.10 and 0.21 for saline controls and 0.21, 0.1 and 0.12 for CPT-11-treated tumors.

For in vivo efficacy studies, mice were inoculated with Colo205 cells, 5 million cells/mouse, on the right dorsal flank area subcutaneously, in a volume of no more than 0.2 mls. When tumors reached a mean tumor volume of about 100-200 mm$^3$, mice were grouped into treatment groups of 8 to 10 mice, each to begin the following treatments. All IV injection were delivered into the tail vein.

Groups:

Vehicle (PBS) only'IV, volume of 0.1 mls, 1×/week for 4 weeks.

Anti-E48-vc-MMAE only—4 mg/kg, IV, volume of 0.1 mls, 1×/week for 4 weeks.

Anti-IL8-vc-MMAE only—4 mg/kg, IV, volume of 0.1 mols, 1×/week for 4 weeks.

Vehicle (PBS)+CPT-11—IV, volume of 0.1 mls, 1×/week for 4 weeks+CPT-11, 80 mg/kg, IP, volume of 0.2 mls, treatment on day 0, 4 & 8 only.

Anti-IL8-vc-MMAE+CPT-11—3 mg/kg, IV, volume of 0.1 mls, 1×/week for 4 weeks+CPT-11, 80 mg/kg, IP, volume of 0.2 mls, treatment on day 0, 4 & 8 only.

Anti-E48-vc-MMAE—3 mg/kg, IV, volume of 0.1 mls, 1×/week for 4 weeks+CPT-11, 80 mg/kg, IP, volume of 0.2 mls, treatment on day 0, 4 & 8 only.

Tumor volumes were measured by cliper twice per week for a duration of 8 weeks or until tumors ulcerated or reached a volume of greater than 1000 mm$^3$. Tumor volume (mm$^3$) was calculated as a×b$^2$×0.5, where a and b are the lung and short diameters of the tumor, respectively.

Preparation and analysis of tumor RNA—Tumor xenograft specimens were homogenized in 3.5 ml of lysis buffer (4 M guanidine thiocyanate, 25 mM sodium citrate, 0.5% N-laurylsarcosine, 0.7% 2-mercaptoethanol) and layered on 1.5 ml of a 5.7 M cesium chloride, 50 mM EDTA (pH 8.0) solution. Following centrifugation at 150,000×g overnight, the RNA pellet was dried, resuspended in water, phenolchloroform-extracted, and ethanol-precipitated. The RNA was finally resuspended in water and the integrity of the RNA preparations was monitored by visualization of 18S and 28S ribosomal RNA on Agarose gels and found to be of good quality.

Oligonucleotide Array Analysis—Approximately 10 µg of total RNA purified from tumor specimen served as starting material for the preparation of probes required for oligonucleotide array analysis on the Affymetrix Human Genome U95 Gene Chip® set. Probes were prepared according to previously described protocols (Wodicka et al. (1997) Nat. Biotechnol. 15:1359-1367) and as per the manufacturer's recommendations. Following hybridization, the arrays were washed and stained with streptavidin-phycoerythrin and then scanned with the Gene Array scanner (Aglient Technologies). Default parameters provided in the Affymetrix data analysis software package (Micro Analysis Suite version 4) were applied in determining the signal intensities, referred to as average difference. Sample normalization was done using global scaling (as stated in the Affymetrix "Expression Analysis Technical Manual") and a target intensity of 1500 was used to determine average difference expression values. The average difference obtained with probes derived from tumors treated with CPT-11, were base-lined against average differences obtained from probes prepared from saline control tumors to generate the fold-difference value for each gene call. A fold-difference value was determined by comparing each of three CPT-11-treated samples to each of the three control samples resulting in nine possible fold-difference values for each gene call. The fold-difference for each of the nine pair-wise comparisons and an average with standard deviation is presented for each gene set listed in Table I. Normal mouse colon tissue was also resected from the experimental and control animals and the extracted RNA subjected to analysis on Affymetrix Mu74Av2 chip set essentially as described for the human tumor xenografts. The mouse data presented in Table II only lists the average fold-differences and standard deviations for the indicated genes.

Real-Time PCR (TaqMan®)'The source of RNA used for RT-PCR analysis was the same as that used for the preparation of probes for oligonucleotide array analysis. Quantitative Reverse Transcriptase-PCR (RT-PCR) was performed using TaqMan® assay reagents from Perkin-Elmer, Applied Biosystems, 50 µl RT-PCR reactions consisted of 5 µl 10× TaqMan Buffer A, 300 µM of each dNTP, 5 mM $MgCl_2$, 10 unites of RNase inhibitor, 12.5 units of MuLV Reverse Transcriptase, 1.25 units of AmpliTaq Gold DNA Polymerase, 200 nM probe, 500 nM primers and 100 ng RNA. Reaction conditions consisted of reverse transcription at 48° C. for 10 minutes, denaturation at 95° C. for 10 minutes, and 40 thermal cycles of 95° C. for 25 seconds, and 65° C. for 1 min. Reaction products were analyzed on 4-agarose gels (Invitrogen). Fold-induction for each gene of interest was determined using the $\Delta\Delta Ct$ method and the result is presented relative to both GAPDH and actin in each figure. The following specific probes and primer sets were used for MFGE8 (Acc#U58516): forward primer: GGTACCATGTGCCACAACTG (SEQ ID NO: 1), reverse primer: GAGGCAACCAGGGAGACA (SEQ ID NO: 2), and probe: CCCCTGTCCCCAAGAACACTTCC (SEQ ID NO: 3); GPC1 (Acc#X54232): forward primer: GCTGTCCTGAACCGACTGA (SEQ ID NO: 4), reverse primer: GGGACGGTGATGAAAAGC (SEQ ID NO: 5), and probe: AGCAGCACTAAGCGGCCTCCC (SEQ ID NO:6); AQP3 (Acc# N74607): forward primer: CTGGCAGCTCCTCCATGT (SEQ ID NO: 7), reverse primer: CCCATCTGTGCCATAAGGA (SEQ ID NO: 8), and probe, AAGCCCTGGAAACATACACACCC (SEQ ID NO: 9); CDH17 (Acc#83228): forward primer: CCTACTCTGCAAACCTTGGTAA (SEQ ID NO: 10), reverse primer: TGTATGCATGGCAGGTAGTG (SEQ ID NO: 11), and probe: AAATCTGGCCAGCTGACTGGTTCC (SEQ ID NO: 12); Ly6D/E48 (Acc#Y12642): forward primer: GGGGATTCCACACCTCTCT (SEQ ID NO: 13); reverse primer: CCAAGTCATCAGCATTCCAT (SEQ ID NO: 14); and probe: CCAGACTTTCGGGGAAGCCCTC (SEQ ID NO: 15); and Ly6E/SCA-2 (Acc# U66711): forward primer: CAGCTGCATGCACTTCAA (SEQ ID NO: 16); reverse primer: AGGACTGGCTGGATTTGG (SEQ ID NO: 17); and probe: CCTAGACCCGGAAGTGGCAGAAAC (SEQ ID NO: 18).

In situ hybridization-All antisense and sense $^{33}P$-labeled riboprobes were generated from PCR products derived from cDNA libraries. The antisense and sense riboprobes for Periplakin were 633 bp in length and were primed with the oligonucleotides containing the sequences upper 5'GACTGGACAACTGGGATGC3' (SEQ ID NO: 19) and lower 5'GACTCCAGCCACCAGGTTTAT3' (SEQ ID NO: 20), respectively. The antisense and sense riboprobes for Aquaporin-3 were 425 bp in length and were primed with the oligonucleotides containing the sequences upper 5'CAAGCTGCCCATCTACACCCT3' (SEQ ID NO: 21) and lower 5'GCTGGCCGGTCGTGAA3' (SEQ ID NO: 22), respectively. The antisense and sense riboprobes for Antileukoproteinase were 378 bp in length and were primed with the oligonucleotides containing the sequences upper 5'TGCCCAGTGCCTTAGATACAA3' (SEQ ID NO: 23), lower 5'CCCCAAAGGATATCAGTG3' (SEQ ID NO: 24), respectively. The hybridization experiments were conducted as described previously (Holcomb et al. (2000) *EMBO J.* 4046-4055).

Preparation of anti-E48 monoclonal antibodies and Anti-E48-val-cit-MMAE Immunoconjugate. BALB/c mice (Charles River Laboratories, Wilmington, DE) were immunized with Baculovirus-derived his8-tagged (SEQ ID NO: 25) LY6D/E48 protein and diluted in Ribi adjuvant (Corixia; Hamilton, MT)) twice a week, via footpad, 5 doses. B cells from lymph nodes were harvested from 5 mice demonstrating high serum titers were fused with mouse myeloma cells (X63.Ag8.653; available from ATCC). After 10-14 days, the supernatants were screened for antibody production by direct ELISA and by flow cytometry on PC-3 cells stably expressing gD-tagged E48. Positives were subcloned twice to achieve monoclonality. For large-scale production of purified antibody, hybridoma cells were injected i.p. into pristine-primed Balb/c mice. The ascites fluids were pooled and purified by protein A affinity chromatography (Pharmacia Fast Protein Liquid Chromatography; Pharmacia, Uppsala, Sweden).

For flow cytometry, cells were grown to 90% confluence and removed from plates using 2 mM EDTA in PBS. Cells were washed and resuspended in FACS buffer (PBS with 1% BSA) and incubated for 60 min with anti-LY6D/E48 monoclonal antibody 15A5 or 17H7 or anti-gd antibody (Genentech, Inc.) followed by 60 min with anti-mouse secondary antibody conjugated to PE. Analysis was performed on FACS scan.

The conjugation of the anti-E48 antibody and control anti-IL8 antibody with MMAE were performed by Seattle Genetics Inc., as described elsewhere (Doronina, 2003: *Nat Biotechnol* 21;778-84).

Results

Nude mice were inoculated with colo205 colorectal cancer cells and tumors were established over a period of two weeks. At this time, intraperitoneal injections of CPT-11 or saline were administered every fourth day, and 24 hours after the third injection tumor and normal tissues were resected. The average mass of the tumors at this time was approximately 300 mg and did not differ significantly between the control and drug treated groups.

Figure 7:
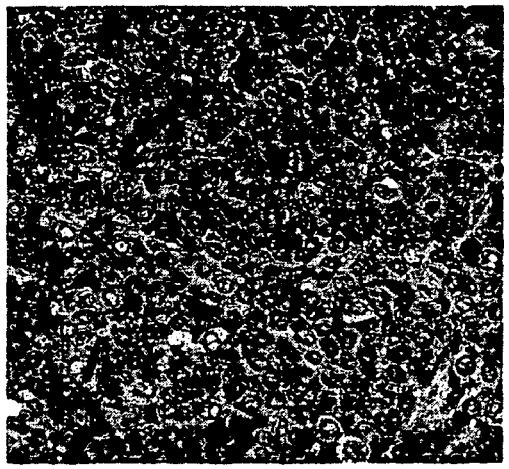
FIG. 7. H&E staining of Colo205 human tumor xenografts. Tumor xenografts were fixed in formalin/ethanol and sections were stained with hematoxylin and Eosin. Examples of tumors from mice administered CT-11 (right) or saline (left) are presented.
Figure 7:
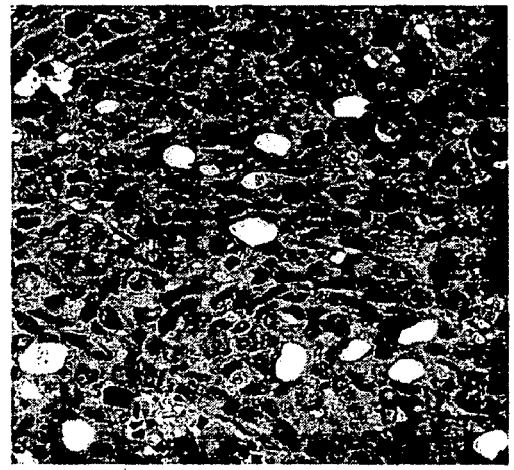

To examine the induction of mRNA transcripts at the cellular level, in situ hybridization was performed on sections obtained from the tumors treated with CPT-11 or saline control. By H&E staining, the cells in the Colo205 and DLD-1 tumors treated with CPT-11 appeared slightly swollen and the nuclei enlarged relative to the saline-treated controls (FIG. 7). However, the cells were largely viable with only a minor increased in the number of apoptotic bodies. This is consistent with gross macroscopic observations indicating no decrease in tumor volume at the time of resection.

RNA purified from three of the saline and three of the CPT-11 treated tumors was subjected to oligonucleotide microarray analysis for transcript expression. Fold change values for each drug treated tumor compared to each control tumor is presented for the tip 43 transcripts identified as upregulated on the U95Av2 chip (Table I). A 100% agreement indicates that all 9 of the possible pair-wise comparisons scored positive for upregulation of the indicated transcript, whereas 89% indicates 8/9 comparisons were positive, and so forth. In this study, focus was on transcripts that scored positive in at least 6/9 possible comparisons. Transcripts that underwent significant upregulation in all three CPT-11 treated tumors relative to controls, identified and confirmed by real-time PCR, included milk fat globule-EGF factor 8 protein (MFGE8), Glypican-1 (GPC1), Aquaporin-3 (AQP3), cadherin-17 (CDH17), E48 antigen (LY6D) and the LY6D homolog SCA-2 (LY6E) (FIG. 1A). Among these, LY6D/E48 exhibited the most consistent and robust induction and was chosen for further studies as a potential antibody target.

To validate expression data by a second method, 20 transcripts that scored positive on the U95Av2 chip were chosen, and their relative expression levels were examined by real-time PCR (TaqMan) using the same 6 RNA samples employed for the microarray analysis. By this method, all 20 of the transcripts were confirmed to be significantly upregulated. Although the degree of upregulation of a given transcript varied somewhat between the two methods, the overall fidelity of the microarray data is strongly supported by the results of real-time PCR analysis.

Figure 2:
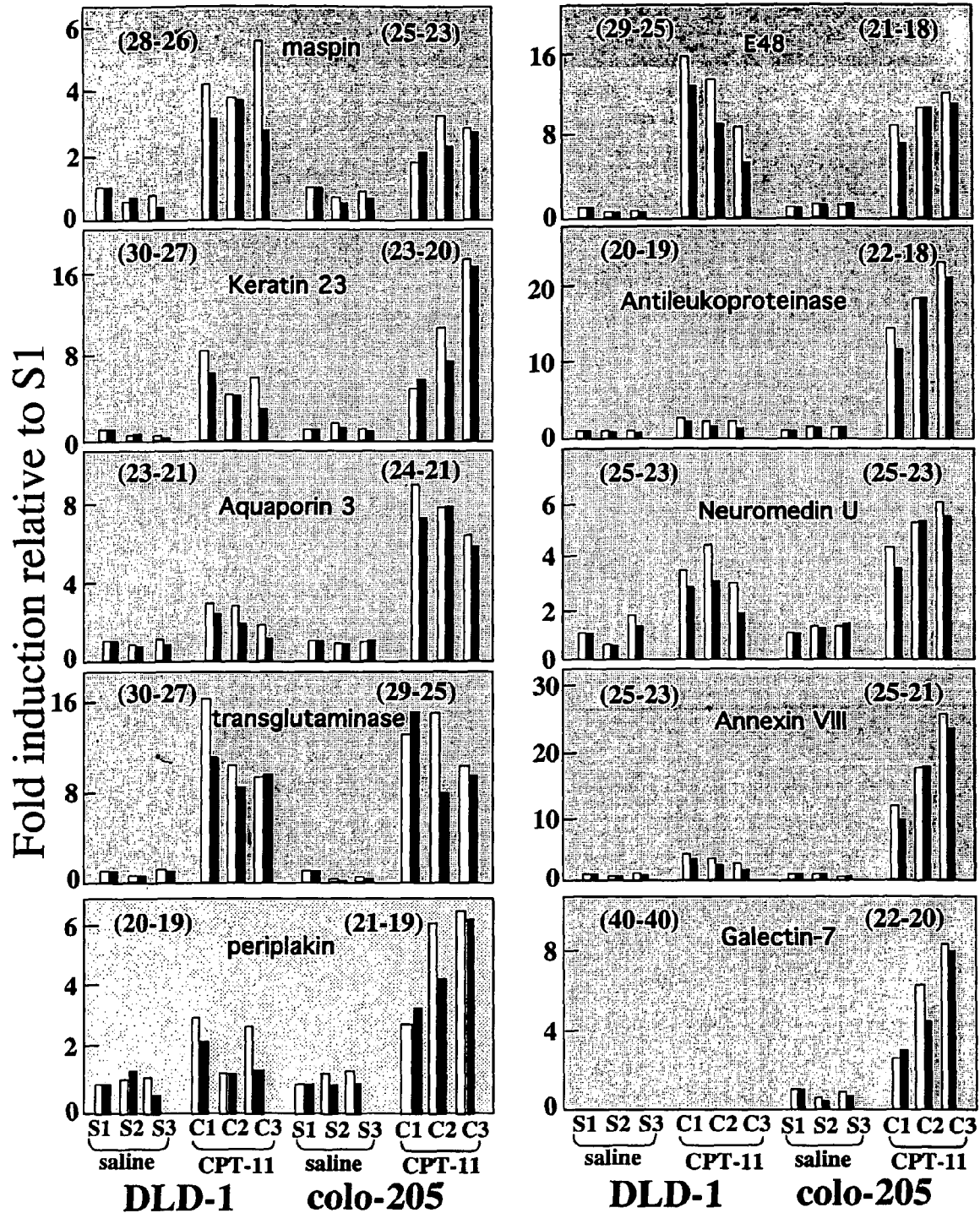
FIG. 2. Real-time PCR analysis of mRNA transcripts identified by microarray analysis. The relative expression levels of the some of the genes induced by CPT-11 (Table I) were compared in a parallel analysis using RNA extracted from the Colo205 and DLD-1 tumors. Cycle threshold values were normalized to both GAPDH (white bars) and Actin (black bars) and fold increases are relative to S1, which was set to a value of one.
Figure 3:
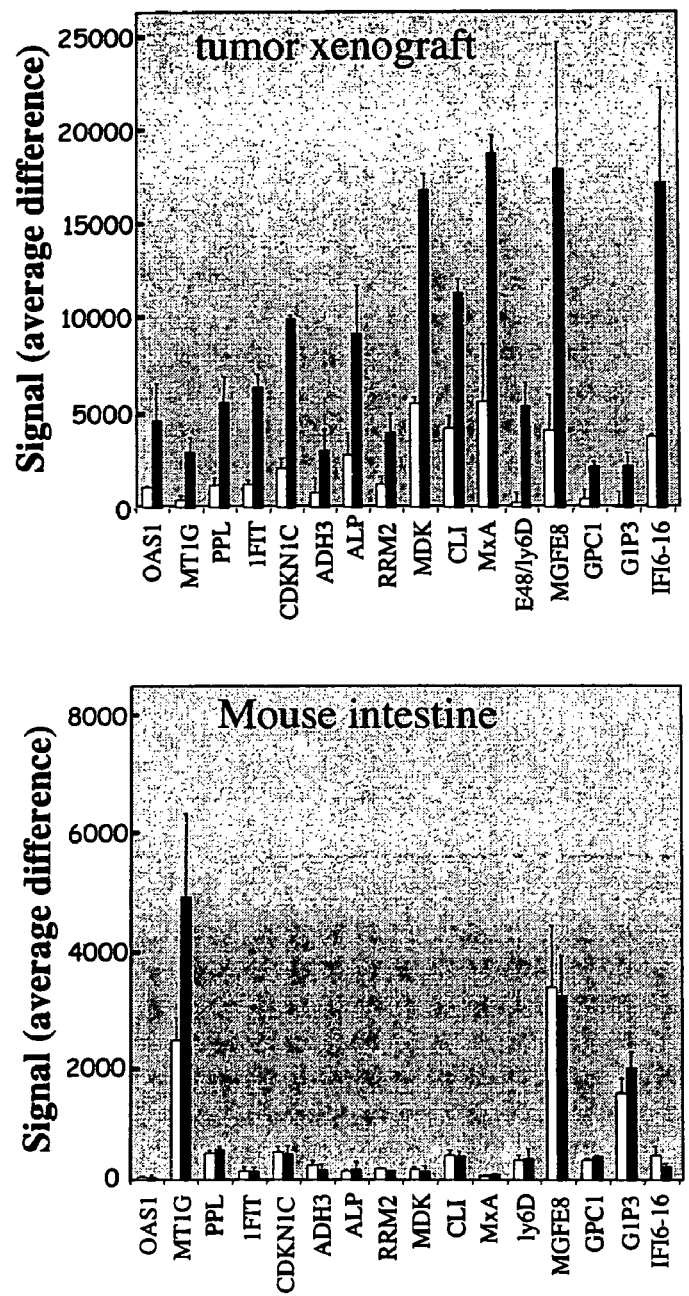
FIG. 3. Expression of mouse intestinal transcripts homologous to those induced in human tumor xenografts. Signal intensities are presented via standard deviations obtained by oligonucleotide array analysis of RNA extracted from three independent human tumor xenografts from mice treated with CPT-11 (black bars) or saline control (white bars). The indicated transcripts are those that underwent the highest and most consistent induction on the human array (upper panel) determined by a fold-change algorithm (Table I) and that were also represented by a homolog on the mouse array (lower).

The relative expression levels of the some of the genes induced by CPT-11 were compared in a parallel analysis using RNA extracted from the Colo205 and DLD-1 tumors. To varying degrees, most of the genes were induced by CPT-11 treatment of both tumor types (FIG. 2). Periplekin and Antileukoproteinase were both strongly expressed by the control DLD-1 tumors, but were induced by SPT-11 to a degree less than that observed for the Colo205 tumors. By contrast, Galectin-7 MRNA was undetectable in both treated or control DLD-1 tumors but was present and induced by CPT-11in the Colo205. Activation of Keratin23 and E48 occurred in both tumor types in response to CPT-11, but these two transcripts were approximately 100-fold lower in the DLD-1 control tumors relative to the Colo205 control tumors. Neuromedin U, Annexin VIII, Transglutaminase, Aquaporin-3 and Maspin were all induced by SPT-11 and expressed at comparable levels in the Colo205 and DLD-1 tumors.

The results of in situ hybridization demonstrate that the genes upregulated by CPT-11 are expressed by the human tumor cells and not by murine stromal cells that could potentially infiltrate the tumor xenografts. Moreover, in Colo205 and DLD-1 cells treated in vitro with CPT-11, again, upregulation of some of the genes listed in Table I was observed (data not shown). As noted above, among the genes that exhibited a robust response to CPT-11 in vitro was that coding for the LY6D/E48 antigen. This antigen has been reported to be upregulated in head and neck cancers and has been proposed as a target for antibody-based therapy in this disease (Brankenhoff et al. (1995) *Cancer Immunol. Immunother.* 40:191-200).

To determine whether the induction of LY6D/E48 by CPT-11 was cell autonomous, LY6D/E48 transcript levels were measured in cultured Colo205 cells following addition of 10 µM CPT-11. This relatively high concentration of drug is required in vitro due to inefficient conversion of CPT-11 by caroxylesterases to the more active moiety SN-38 (OOsterhoffet al., *Mol Cancer Ther.* 2:765-71 (2003)). The LY6D/E48 transcript was elevated within 24 hours post-treatment with a further enhancement by 48 hours (FIG. 1B). It was possible that Colo205 was an unusually sensitive cell line with respect to activation of LY6D/E48 by CPT-11. Therefore, additional cell lines were investigated. The LU6D/E48 transcript could not be detected in the absence or presence of CPT-11 in the human prostate cancer PC3 cell not in the human embryonic kidney cell line 293. However, in addition to the Colo205, three colorectal cancer cell lines, DLD-1, HCT116 and HT29, and the fibrosarcoma cell line HT1080, overexpressed LY6D/E48 MRNA in response to CPT-11 (FIG. 1C).

A critical assumption in targeting tumor cell-surface proteins induced by chemotherapeutics is that the drug will not also induce the target in the normal tissue To examine this, normal intestine was resected from the tumor-bearing mice that were administered CPT-11 or saline control and performed oligonucleotide array analysis on mouse specific chips. Real-time PCR with primers specific for corresponding mouse transcripts was performed and with the exceptions of SPRR3 and Aquaporin-3, all of the mouse homologs were readily detected in RNA from mouse colon. However, no difference in expression of these genes was detected when normal colon tissue from CPT-11 treated mice was compared to that from the control group (data not shown). To identify any mouse that underwent significant changes in expression in response to CPT-11, oligonucleotide microarray analysis was performed using mouse specific oligonucleotide array Mu74Av2. Treatment of animals with CPT-11 resulted in the activation of a small number of genes in the colon, but they were unrelated to most of those induced in the human tumor xenografts (Table II). Many of the genes induced in normal colon likely reflect an acute immunological response to tissue damage. For example, the Ig variable chain transcripts are highly specific to lymphoid cells and probably emanate from immune cells present in the gut. It has further been found that some of the cryptidin genes, which are expressed by intestinal paneth cells for the purpose of microbial defense (Ayabe et al. (2002) *J. Bio. Chem.* 277:5219-5228), were activated in two of the three animals treated with CPT-11. These results suggest that colorectal tumor cells and normal colon cells respond very differently to DNA damaging agents.

Figure 8:
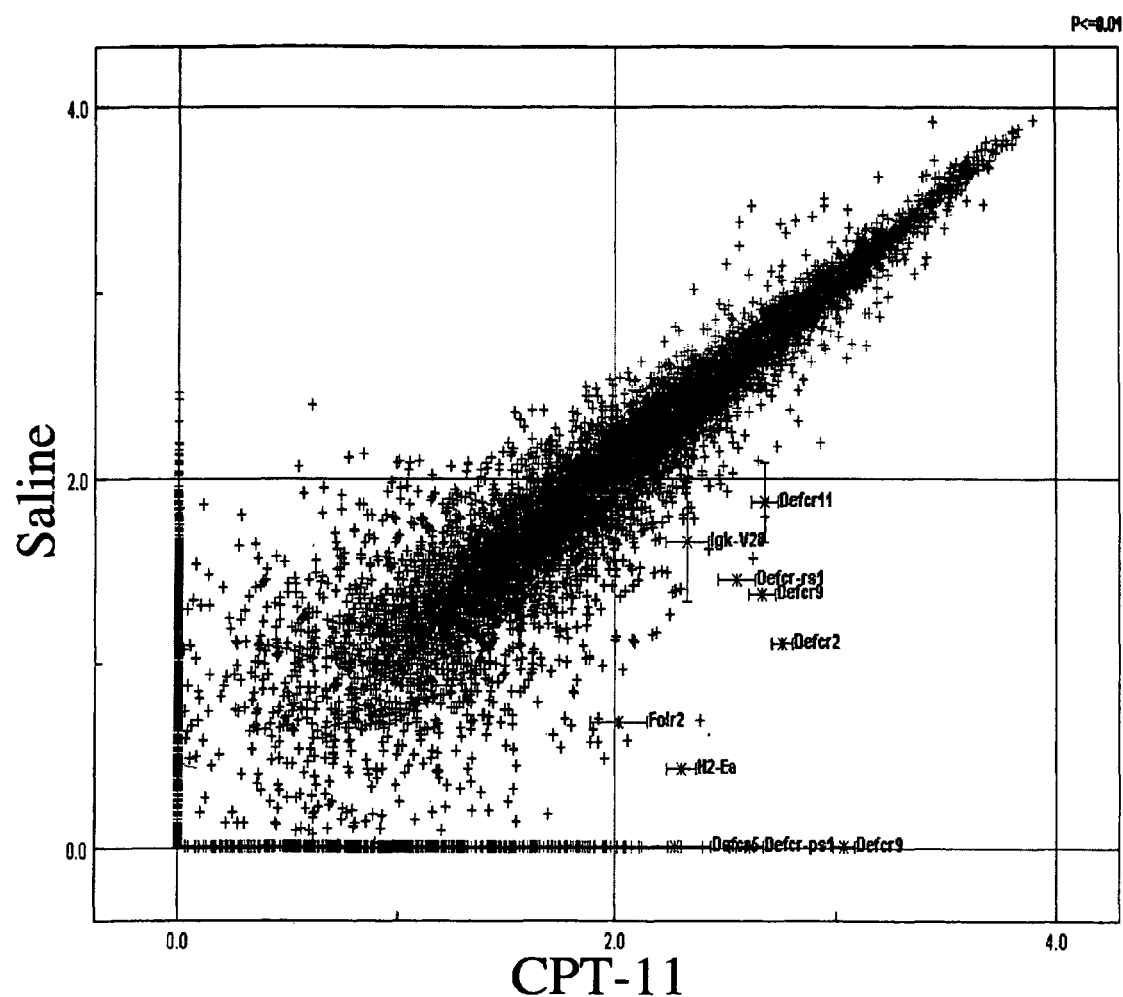
FIG. 8. Scatter plot of gene expression data for normal intestine. Oligonucleotide array data obtained with RNA extracted from normal intestine of tumor bearing mice treated with saline (Y-axis) or CPT-11 (X-axis) presented as a 2-D plot. Signal intensities for all probes on the Mu74Av2 mouse chip set are plotted on a $\log_{10}$ scale. Most probes fall on the diagonal, which indicates no difference on treatment with CPT-11.

More detailed analysis has shown that apart from Metallothionein (MT1G), none of the transcripts that were induced in the tumors by CPT-11 were induced in the normal mouse intestine (FIG. 2, Tables I and II). Further analysis of individual mouse transcripts by real-time PCR was also consistent with this lack of response (data not shown). Surprisingly, the normal mouse intestine was quite refractory to changes in gene expression in response to treatment with CPT-11, as evidenced by a 2-dimensional matrix plot of saline vs. CPT-11 for an entire Mu74A gene chip (FIG. 8). Nevertheless, evidence of physiological stress was apparent from the genes that were induced as they largely coded for proteins involved in detoxification (cytochrome p450, metallothionein), microbial defense (defensins) and immunological responses (immunoglobins) (Table II).

Figure 4:
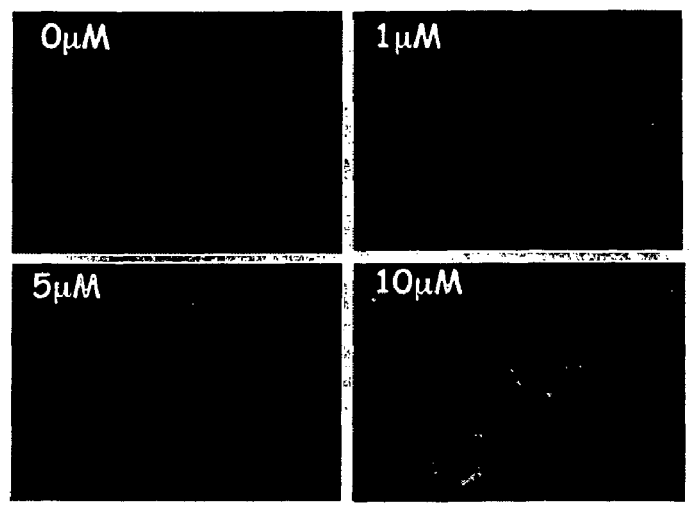
FIG. 4. Induction of E48/Ly-6D gene expression in Colo205 cells by CPT-11 in vitro. Cultured Colo205 cells were incubated with the indicated concentrations of CPT-11 for 2 days and then subjected to immunofluorescent straining (A) or fluorescent activated cell sorting (B) using monoclonal antibodies specific to E48/Ly-6D. Immunofluorescent staining for E48/Ly-6D was performed with antibody 15A5 (green) and the cells counter stained with DAPI (blue) to localize nuclei. Fluorescent activated cell sorting was performed with two independent monoclonal antibodies to E48/Ly-6D (15A5 and 17H7), a control antibody reactive to an epitope not present on E48 (GD) and with secondary (2°) antibody only.
Figure 4:
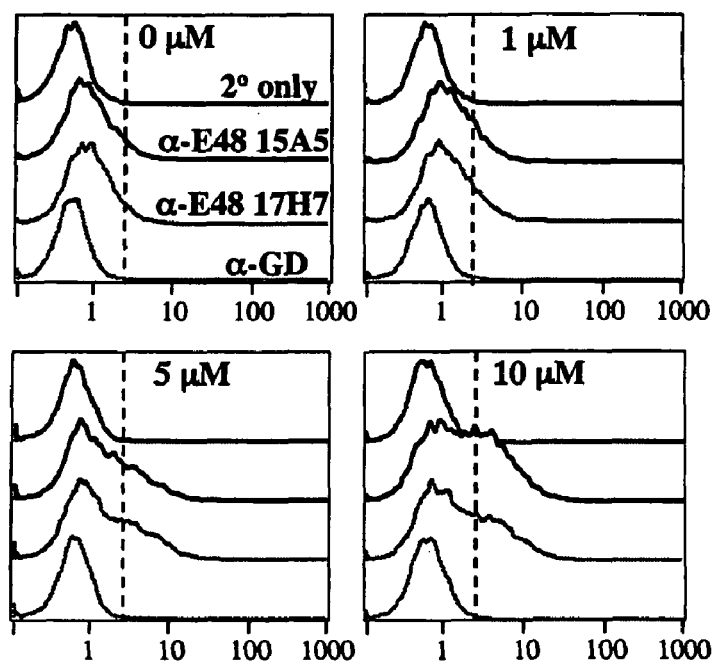

To obtain monoclonal antibodies to LY6D/E48, mice were immunized with purified recombinant protein. Hybridomas producing immunoglobulins with strong specific reactivity to transfected cells stably expressing LY6D/E48 were identified. When Colo205 cells were exposed to increasing concentrations of CPT-11 in vitro, the intensity of the signal measured by fluorescence activated cell sorting increased in a dose dependent manner (FIG. 4B). Also, the signal intensity and percentage of reactive cells observed by immunofluorescent microscopy of intact cells increased with drug dosage (FIG. 4A).

Figure 5:
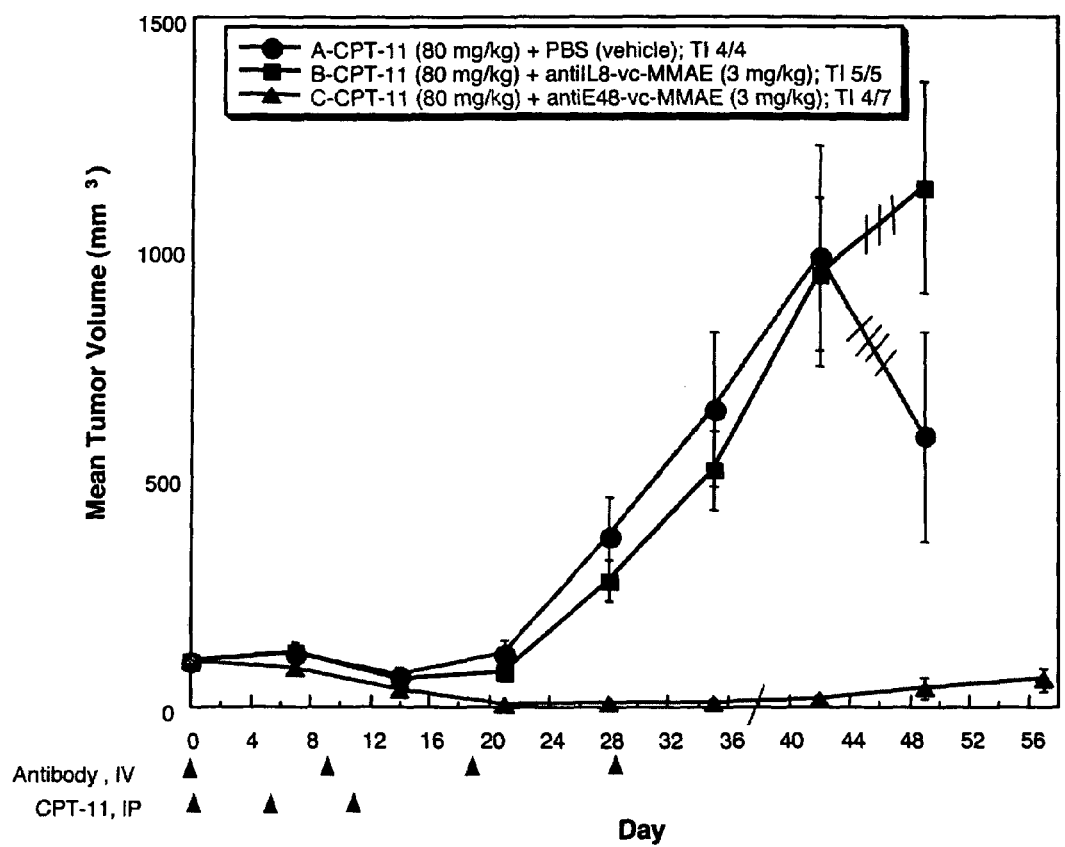
FIG. 5. Effect of CPT-11 and anti-LY6D/E48-vc-MMAE on tumor growth in vivo. Mice were inoculated with colo205 human colorectal cancer cells. Following the appearance of palpable tumors, animals were administered three doses of 80 mg/kgCPT-11 alone or in combination with 3 mg/kg anti-LY6D/E48-vc-MMAE or anti-IL8-vc-MMAE, as a negative control, according to the indicated schedule.
Figure 6:
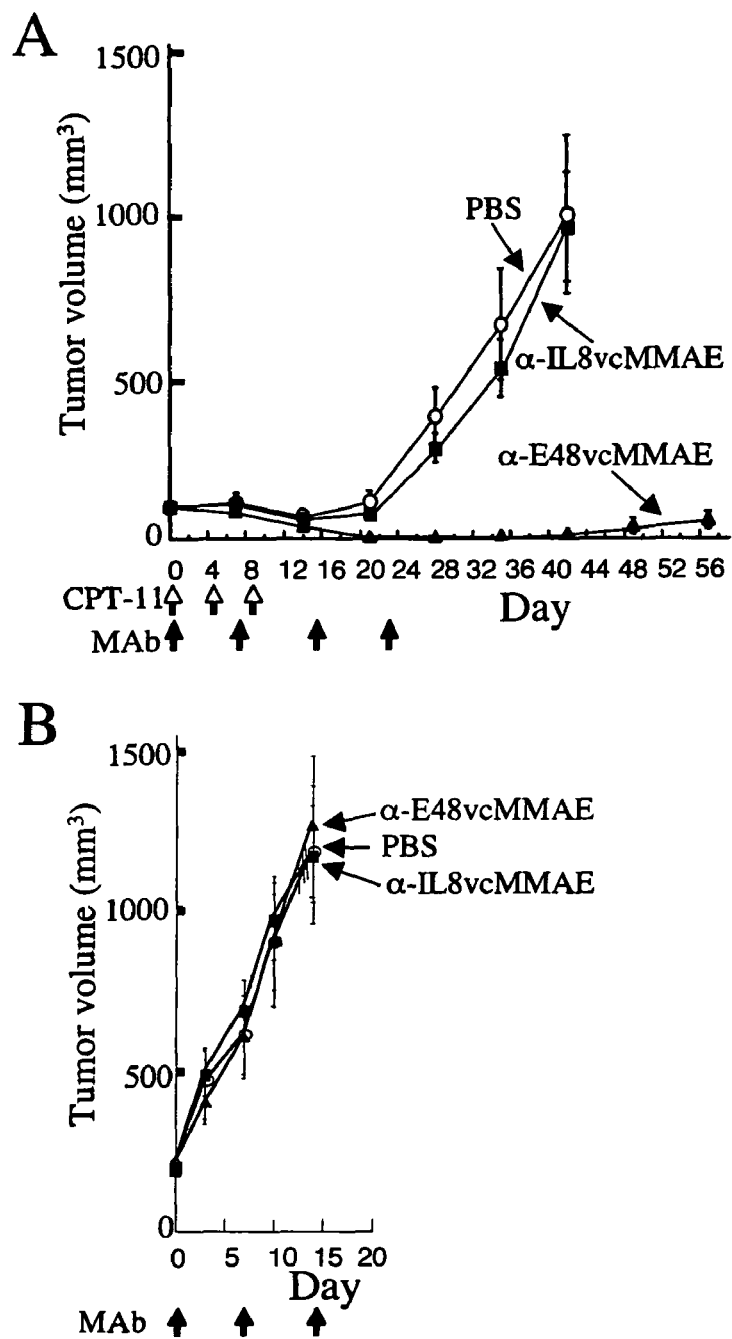
FIG. 6. Anti-tumor activity of CPT-11 combined with anti-LY6D/E48 immunoconjugate. A. Nude mice bearing Colo205 human tumor xenografts were administered three doses of CPT-11 at 80 mg/kg (open arrows) plus four doses at 3 mg/kg of either anti-LY6D/E48-vc-MMAE or control immunoconjugate anti-IL8-vc-MMAE (closed arrows). A third group received CPT-11 plus MAb vehicle (PBS). B. The immunoconjugates and PBS control were administered in the absence of CPT-11.

To determine whether the induction of gene coding for cell surface protein could be exploited in targeted cancer therapy the effects of a drug-conjugated anti-LY6D/E48 monoclonal antibody on tumor growth was tested. Colo205 cells were inoculated into nude mice and CPT-11 was administered when the tumors reached approximately 200 mm$^3$. CPT-11 was administered alone or in combination with either anti-LY6D/E48-vc-MMAE or as a negative control, anti-IL8-vc- MMAE. Although CPT-11 alone transiently reduced the rate of tumor growth, regrowth occurred at rapid rate following the last administration. However, in combination with anti-LY6D/E48-vc-MMAE, but not anti-IL8-vc-MMAE, tumor growth was retarded for a significantly longer period of time (FIG. 5, FIG. 6A). In animals receiving CPT-11 plus the anti-LY6D/E48-vc-MMAE conjugate, 6 of 8 exhibited complete responses with minimal tumor mass in the remainder of the animals out to 8 weeks. Anti-LY6D/E48-vc-MMAE conjugate did not exhibit any antitumor activity relative to vehicle or the control MAb conjugate in the absence of CPT-11 coadministration (FIG. 6B). These results indicate a synergistic activity between CPT-11 and antibody-drug conjugate directed against an antigen induced by CPT-11.

Discussion

Current chemotherapeutic regimens for colorectal cancer involve concomitant administration of antimetabolites and DNA damaging agents that produce errors on replication of DNA (Tebbutt et al. (2002) Eur. J. Cancer 38:1000-1015). The therapeutic index of these drugs likely relates to the relative increased rate of proliferation of cancer cells and perhaps to the impaired ability of cancer cells to correct or eliminate the damage. The response of tumors to these drugs varies widely and drug resistant tumors frequently arise following their administration. Having a detailed understanding of the manner in which tumor cells respond to chemotherapeutic agents would aid in the development of more effective therapies. Monitoring the response to drug treatment at the level of gene expression is difficult, though, as tumor specimens from recently treated patients are not easily obtained. In the experiments presented in this Example, clinical circumstances have been approximated by growing human tumors in mice and assessing changes in gene expression that occur shortly after drug treatment. A substantial finding from these studies is that certain colorectal tumors, particularly those with wild-type p53, launch a robust gene expression program that resembles that engaged by squamous epithelial cells.

The experiment presented here was designed to identify genes that were acutely activated by CPT-11 prior to the onset of the more dramatic responses to the drug, as determined by changes in tumor volume. At time of tumor resection, tumor cells appeared largely viable and the volumes of the tumors were not reduced relative to the saline treated controls.

The specific alterations in gene expression that were observed in colon tumor xenografts in response to CPT-11 were not observed in normal mouse colon. Exposure to drug likely occurred in this tissue as noticeable changes in gene expression were apparent in the CPT-11 treated animals. Our results suggest that normal colon tissue is buffered against radical responses to genotoxic insults, whereas cancer cells undergo dramatic and rapid responses at the level of gene induction. Exploiting the differential response between normal cells and cancer cells to a primary therapeutic can be exploited to provide novel combination therapies with enhanced efficacy. In particular, combination therapy with a primary chemotherapeutic drug and an antagonist of a gene differentially induced in cancer cells as a result of treatment with the primary chemotherapeutic drug is expected to improve the efficacy of cancer treatment. Thus, for example, antibodies or small molecules directed at targets selectively induced in cancer cells by primary therapeutics hold promise to improve the therapeutic index of drug combination.

In a particular aspect, the results presented herein demonstrate that LY6D/E48, which is commonly upregulated n a variety of cancer cell lines in response to CPT-11, is an effective target for an immunoconjugate when used with the inducing drug.

All references cited throughout the disclosure are hereby expressly incorporated by reference. Although the invention is illustrated by reference to certain embodiment, it is not so limited. Indeed, various modifications of the invention in addition to those shown and described herein will become apparent to those skilled in the art from the foregoing description and fall within the scope of the appended claims.

TABLE I

Genes upregulated by treatment of Colo205 tumor xenografts with CPT-11

| Affy probe ID | C#1 | | | C#2 | | | C#3 | | | Avg fold | SD | % AGREE | Accession #/Description |
|---|---|---|---|---|---|---|---|---|---|---|---|---|---|
| | S#1 fold[a] | S#2 fold | S#3 fold | S#1 fold | S#2 fold | S#3 fold | S#1 fold | S#2 fold | S#3 fold | | | | |
| 39230_at | 8 | 9.6 | 13.6 | 9.2 | 10.4 | 16.4 | 17.3 | 19.3 | 28.7 | 15 | 7 | 100 | AL022318/Phorbolin 3 |
| 36284_at | 12 | 10.1 | 7.9 | 14 | 12 | 7.9 | 13 | 12 | 8.2 | 11 | 2 | 100 | Y12642/E48 |
| 38608_at | 7.9 | 7.8 | 7.5 | 6.7 | 6.8 | 8 | 11.9 | 12 | 11.2 | 9 | 2 | 100 | AA010777/galectin7 |
| 38388_at | 4.7 | 5.9 | 4.9 | 6 | 6.8 | 6 | 6.2 | 7.7 | 6.4 | 6 | 1 | 100 | M11810/(2–5) oligo A synthetase E |
| 926_at | 7.8 | 5.1 | 5.8 | 7.1 | 5 | 6.6 | 5.5 | 3.3 | 4.6 | 6 | 1 | 100 | J03910/metallothionein-IG (MT1G) |
| 36890_at | 5.2 | 2.5 | 3.5 | 7.7 | 3.8 | 5.1 | 9.9 | 4.8 | 7.6 | 6 | 2 | 100 | AF001691/Periplakin |
| 915_at | 4.4 | 5.9 | 4.4 | 5.3 | 7.1 | 5.3 | 4.5 | 6 | 4.5 | 5 | 1 | 100 | M24594/Human interferon-inducible 56 Kd protein |
| 39545_at | 6.9 | 4 | 4.2 | 7.2 | 4.1 | 4.4 | 7.2 | 4.1 | 4.4 | 5 | 1 | 100 | U22398/Cdk-inhibitor p57KIP2 |
| 34823_at | 4.5 | 3 | 3.3 | 5.2 | 3.4 | 4.7 | 6.1 | 4 | 4.5 | 4 | 1 | 100 | X60708/dipeptidyl peptidase IV |
| 1358_s_at | 3.6 | 3.9 | 3.6 | 4.9 | 5.3 | 4.9 | 3.8 | 4.1 | 3.8 | 4 | 1 | 100 | U22970/Human interferon-inducible peptide (6–16) |
| 40031_at | 1.8 | 3.6 | 4.1 | 2.1 | 4.4 | 4.9 | 2.6 | 6.9 | 7.3 | 4 | 2 | 100 | M74542/aldehyde dehydrogenase type III |
| 37014_at | 2 | 3.6 | 7.3 | 2.1 | 3.9 | 7.9 | 1.8 | 3.3 | 5.3 | 4 | 2 | 100 | M33882/p78 protein (MxA) |
| 32275_at | 2.5 | 2.3 | 4.7 | 2.6 | 2.4 | 5 | 3.8 | 3.5 | 8.1 | 4 | 2 | 100 | X04470/antileukoprotease |
| 34965_at | 3.2 | 3 | 2.6 | 3.9 | 3.7 | 3.2 | 4.5 | 4.2 | 3.6 | 4 | 1 | 100 | AF031824/leukocystatin |
| 36922_at | 5.2 | 3 | 4 | 4.1 | 2.5 | 3.3 | 3.6 | 2.2 | 3 | 3 | 1 | 100 | X59618/small subunit ribonucleotide reductase |
| 577_at | 3.3 | 3.6 | 3.7 | 3.1 | 3.3 | 3.5 | 2.9 | 3.2 | 3.3 | 3 | 0 | 100 | M94250/retinoic acid inducible factor (MK) |
| 1787_at | 4.4 | 3.3 | 2.8 | 3.7 | 3 | 2.6 | 4 | 2.8 | 2.4 | 3 | 1 | 100 | U22398/Cdk-inhibitor p57KIP2 |
| 32814_at | 3.3 | 2.9 | 2.9 | 3.9 | 3.5 | 3.4 | 2.7 | 2.4 | 2.3 | 3 | 1 | 100 | M24594/interferon-inducible 56 Kd protein (IFIT1) |

TABLE I-continued

Genes upregulated by treatment of Colo205 tumor xenografts with CPT-11

| Affy probe ID | C#1 S#1 fold[a] | C#1 S#2 fold | C#1 S#3 fold | C#2 S#1 fold | C#2 S#2 fold | C#2 S#3 fold | C#3 S#1 fold | C#3 S#2 fold | C#3 S#3 fold | Avg fold | SD | % AGREE | Accession #/Description |
|---|---|---|---|---|---|---|---|---|---|---|---|---|---|
| 33338_at | 2.7 | 2.9 | 4.2 | 2.5 | 2.6 | 3.8 | 2 | 2.1 | 3.2 | 3 | 1 | 100 | M97936 transcription factor ISGF-3 (STAT1) |
| 36780_at | 3.6 | 2.7 | 2.8 | 3.2 | 2.4 | 2.5 | 3.2 | 2.4 | 2.5 | 3 | 0 | 100 | M25915/complement cytolysis inhibitor (CLI) |
| 39119_s_at | 1.6 | 2.6 | 2.4 | 2.4 | 4 | 3.7 | 1.9 | 3.2 | 2.9 | 3 | 1 | 100 | AA631972/Natural killer cell transcript 4 |
| 38389_at | 1.9 | 2.5 | 2.2 | 2.5 | 3.3 | 2.9 | 2.2 | 2.9 | 2.5 | 3 | 0 | 100 | X04371/2-5A synthetase induced by interferon |
| 39331_at | 2.2 | 2.1 | 2.1 | 2 | 1.9 | 1.9 | 2.8 | 2.7 | 2.7 | 2 | 0 | 100 | X79535/beta tubulin |
| 37420_i_at | 2 | 2.7 | 2 | 1.8 | 2.4 | 1.8 | 2.1 | 2.8 | 2.1 | 2 | 0 | 100 | AL022723/MHC, class I, F (CDA12) |
| 1375_s_at | 2 | 1.9 | 2.2 | 2.2 | 2.1 | 2.4 | 2.1 | 1.9 | 2.3 | 2 | 0 | 100 | M32304/TIMP2 |
| 39677_at | 1.9 | 2.1 | 2 | 2 | 2.2 | 2 | 2.1 | 2.3 | 2.1 | 2 | 0 | 100 | D80008/KIAA0186 |
| 296_at | 1.8 | 1.8 | 1.9 | 1.9 | 1.9 | 2 | 2.1 | 2.1 | 2.2 | 2 | 0 | 100 | X79535/Tubulin, Beta |
| 770_at | 7.6 | 8 | 2.9 | 7.3 | 8.1 | 3.4 | 6.3 | 6.5 | 6.1 | 6 | 2 | 100 | D00632/glutathione peroxidase |
| 39248_at | 5.8 | 7.9 | 8.1 | 7 | 5.8 | 5.9 | 3.9 | 5.5 | 5.6 | 6 | 1 | 100 | N74607/Aquaporin 3 |
| 38673_s_at | 3.6 |  | 3.8 | 5.1 | 3.4 | 5.6 | 5 | 2.8 | 5 | 4 | 1 | 89 | D64137/p57KIP2 |
| 38124_at | 3.8 | 3.7 | 3.6 | 3.7 | 3.7 |  | 3.7 | 3.6 | 3.5 | 4 | 0 | 89 | X55110/neurite outgrowth-promoting protein (midkine) |
| 34363_at | 2.1 |  | 1.5 | 3.1 | 2.8 | 2.7 | 5.4 | 4.9 | 4 | 3 | 1 | 89 | Z11793/selenoprotein P |
| 39263_at | 2.3 | 4.1 | 3.8 | 2.3 | 4 | 3.7 |  | 2.8 | 2.6 | 3 | 1 | 89 | M87434/oligo A synthetase (p69 2-5A synthetase) |
| 425_at |  | 2.3 | 2.5 | 2.1 | 2.7 | 3 | 2.1 | 2.8 | 3 | 3 | 0 | 89 | X67325/Interferon alpha-inducible protein 27 |
| 32106_at |  | 2 | 1.7 | 2.6 | 3 | 2.5 | 2.6 | 3 | 2.4 | 2 | 0 | 89 | L28101/kallistatin (PI4) |
| 37954_at | 4.7 |  |  | 6.2 | 5.2 | 5.4 | 9.5 | 7.8 | 7.4 | 7 | 2 | 78 | X16662/Annexin VIII |
| 34403_at | 4.6 | 2.3 | 1.8 | 12 | 5.8 | 4.6 | 10.6 |  |  | 6 | 4 | 78 | U58516/breast epithelial antigen BA46 |
| 33399_at | 5.5 | 3.4 | 3 | 4.4 |  |  | 7.1 | 3.6 | 3.7 | 4 | 1 | 78 | AA142942/Ribosomal protein S6 |
| 35099_at | 4.8 |  | 4.1 | 3.4 |  | 3.6 | 5 | 3.1 | 4.1 | 4 | 1 | 78 | AF019225/apolipoprotein L |
| 608_at |  |  | 3 | 2.9 | 3.1 | 3.9 | 4.4 | 4.8 | 4.7 | 4 | 1 | 78 | M12529/Human apolipoprotein E |
| 37039_at | 3.4 | 4 | 3 |  | 3.5 |  | 4.1 | 4.9 | 3.5 | 4 | 1 | 78 | J00194/human hla-dr antigen alpha-chain |
| 38432_at | 1.6 | 3 | 5.2 |  |  | 5.5 | 1.8 | 3.4 | 5.7 | 4 | 2 | 78 | AA203213/Interferon-stimulated protein 15 |
| 879_at | 2.6 | 3.3 | 3.5 |  | 4.3 | 4.2 |  | 4.1 | 3.5 | 4 | 1 | 78 | M30818/interferon-induced (MxB) |

[a] Each CPT-11 treated tumor (C) was compared to each saline control treated tumor (S) to generate a fold increase.

TABLE II

Genes upregulated in mouse colon by CPT-11.

| AFFY Probe ID | % AGREE | Ave fold[a] | Accession/Description |
|---|---|---|---|
| 92202_g_at | 100.00 | 2.25 | AI553024/PLZF, ZNF145 |
| 93996_at | 100.00 | 1.93 | X01026/cytochrome P450 2e1 |
| 93573_at | 100.00 | 1.68 | V00835/Metallothionein 1 |
| 102155_f_at | 88.89 | 3.82 | K03461/Ig kappa light chain |
| 160841_at | 88.89 | 2.07 | AW047343/D site albumin promote BP |
| 94516_f_at | 88.89 | 1.58 | M55181/Preproenkephalin 2 |
| 99369_f_at | 77.78 | 6.73 | AF029261/Ig kappa light chain (Vk10c) |
| 102154_f_at | 77.78 | 5.64 | M13284/Mouse Ig active kappa-chain V-region (V139-J1) |
| 102157_f_at | 77.78 | 4.48 | M15520/Mouse Ig V-kappa10-Ars-A |
| 99405_f_at | 77.78 | 4.38 | U30241/Ig kappa chain mRNA hybridoma 84.15 |
| 101720_f_at | 77.78 | 4.15 | U30629/Ig kappa chain mRNA hybridoma 84.20 |
| 98765_f_at | 77.78 | 1.98 | U23095/CB17 SCID Ig heavy chain clone 58-92 |
| 101561_at | 77.78 | 1.72 | K02236/Metallothionein 2 |
| 104451_at | 77.78 | 1.68 | AI852578/est |
| 160117_at | 77.78 | 1.64 | AI850638/est |
| 103294_at | 77.78 | 1.54 | U67188/G protein signaling regulator RGS5 |
| 95766_f_at | 66.67 | 9.90 | U03066/cryptdin-16 (Defcr16) |
| 100351_f_at | 66.67 | 9.57 | U02997/cryptdin-2 (Defcr2) |
| 93879_f_at | 66.67 | 9.49 | U02999/cryptdin-3 (Defcr3) |
| 92812_f_at | 66.67 | 9.13 | U02995/Defensin related cryptdin peptide |
| 99551_f_at | 66.67 | 7.01 | U12560/cryptdin 5 gene |
| 102814_f_at | 66.67 | 6.76 | M33226/Defensin related sequence |
| 93863_f_at | 66.67 | 6.64 | U03003/cryptdin-6 (Defcr6) |
| 101794_f_at | 66.67 | 3.96 | U12562/cryptdin i gene |
| 100360_f_at | 66.67 | 3.11 | X02466/germline Ig V(H)II gene H17 |
| 103654_at | 66.67 | 2.84 | AB018374/GARP45 |
| 102016_at | 66.67 | 2.38 | M61737 adipocyte-specific mRNA |

TABLE II-continued

Genes upregulated in mouse colon by CPT-11.

| AFFY Probe ID | % AGREE | Ave fold[a] | Accession/Description |
|---|---|---|---|
| 93213_at | 66.67 | 2.05 | AB007986/single chain antibody ScFv |
| 93294_at | 66.67 | 2.01 | M70642/Fibroblast inducible secreted protein |
| 95611_at | 66.67 | 1.89 | AA726364/est |
| 99959_at | 66.67 | 1.76 | AW061337/est |
| 93619_at | 66.67 | 1.75 | AF022992/Period homolog (*Drosophila*) |
| 100144_at | 66.67 | 1.69 | X07699/Nucleolin |
| 98084_at | 66.67 | 1.66 | AI849834/est |
| 99965_at | 66.67 | 1.63 | D31969/Vitamin D receptor |
| 104154_at | 66.67 | 1.61 | AB021961/p53 |
| 96854_at | 66.67 | 1.60 | AJ010391/copa gene |
| 94688_at | 66.67 | 1.60 | X83106/Max dimerization protein |
| 160378_at | 66.67 | 1.58 | AI853127/est |
| 93836_at | 66.67 | 1.56 | AF041054/E1B 19K/(Nip3) |
| 99076_at | 66.67 | 1.54 | U09504/Thyroid hormone receptor alpha |
| 103275_at | 66.67 | 1.51 | U13836/vacuolar adenosine triphosphatase Ac116 |
| 160088_at | 66.67 | 1.51 | U90535/flavin-containing monooxygenase 5 (FMO5) |

[a]Average fold increase from comparison of 3 cpt-11-treated mice to 3 saline-treated mice.

SEQUENCE LISTING (120 sequences)

SEQ ID NO: 1 - DNA, 20 bp, Artificial Sequence
  Description of Artificial Sequence: Synthetic primer
ggtaccatgtgccacaactg

SEQ ID NO: 2 - DNA, 18 bp, Artificial Sequence
  Description of Artificial Sequence: Synthetic primer
gaggcaaccagggagaca

SEQ ID NO: 3 - DNA, 23 bp, Artificial Sequence
  Description of Artificial Sequence: Synthetic probe
cccctgtccccaagaacacttcc

SEQ ID NO: 4 - DNA, 19 bp, Artificial Sequence
  Description of Artificial Sequence: Synthetic primer
gctgtcctgaaccgactga

SEQ ID NO: 5 - DNA, 18 bp, Artificial Sequence
  Description of Artificial Sequence: Synthetic primer
gggacggtgatgaaaagc

SEQ ID NO: 6 - DNA, 21 bp, Artificial Sequence
  Description of Artificial Sequence: Synthetic probe
agcagcactaagcggcctccc

SEQ ID NO: 7 - DNA, 18 bp, Artificial Sequence
  Description of Artificial Sequence: Synthetic primer
ctggcagctcctccatgt

SEQ ID NO: 8 - DNA, 19 bp, Artificial Sequence
  Description of Artificial Sequence: Synthetic primer
cccatctgtgccataagga

SEQ ID NO: 9 - DNA, 23 bp, Artificial Sequence
  Description of Artificial Sequence: Synthetic probe
aagccctggaaacatacacaccc

SEQ ID NO: 10 - DNA, 22 bp, Artificial Sequence
  Description of Artificial Sequence: Synthetic primer
cctactctgcaaaccttggtaa

SEQ ID NO: 11 - DNA, 20 bp, Artificial Sequence
  Description of Artificial Sequence: Synthetic primer
tgtatgcatggcaggtagtg

SEQ ID NO: 12 - DNA, 24 bp, Artificial Sequence
  Description of Artificial Sequence: Synthetic probe
aaatctggccagctgactggttcc

SEQ ID NO: 13 - DNA, 19 bp, Artificial Sequence
  Description of Artificial Sequence: Synthetic primer
ggggattccacacctctct

SEQ ID NO: 14 - DNA, 20 bp, Artificial Sequence
  Description of Artificial Sequence: Synthetic primer
ccaagtcatcagcattccat

SEQ ID NO: 15 - DNA, 22 bp, Artificial Sequence
  Description of Artificial Sequence: Synthetic probe
ccagactttcggggaagccctc

SEQ ID NO: 16 - DNA, 18 bp, Artificial Sequence
  Description of Artificial Sequence: Synthetic primer
cagctgcatgcacttcaa

SEQ ID NO: 17 - DNA, 18 bp, Artificial Sequence
  Description of Artificial Sequence: Synthetic primer
aggactggctggatttgg

SEQ ID NO: 18 - DNA, 24 bp, Artificial Sequence
  Description of Artificial Sequence: Synthetic probe
cctagacccggaagtggcagaaac

SEQ ID NO: 19 - DNA, 19 bp, Artificial Sequence
  Description of Artificial Sequence: Synthetic primer
gactggacaactgggatgc

SEQ ID NO: 20 - DNA, 21 bp, Artificial Sequence
  Description of Artificial Sequence: Synthetic primer
gactccagccaccaggtttat

SEQ ID NO: 21 - DNA, 21 bp, Artificial Sequence
  Description of Artificial Sequence: Synthetic primer
caagctgcccatctacaccct

SEQ ID NO: 22 - DNA, 16 bp, Artificial Sequence
  Description of Artificial Sequence: Synthetic primer
gctggccggtcgtgaa

SEQ ID NO: 23 - DNA, 21 bp, Artificial Sequence
  Description of Artificial Sequence: Synthetic primer
tgcccagtgccttagatacaa

SEQ ID NO: 24 - DNA, 18 bp, Artificial Sequence
  Description of Artificial Sequence: Synthetic primer
ccccaaaggatatcagtg

SEQ ID NO: 25 - protein, 8 aa, Artificial Sequence
  Description of Artificial Sequence: Synthetic 8xHis tag
HHHHHHHH

SEQ ID NO: 26 - DNA, 201143 bp, Homo sapiens
aagcttgctgataggagatcggctgtgaggttcctgttcctgtcgtaacacagcagttctgggattgttttaggagagaaactttgagaggttaaatgagaaaggagccttctggtgggttcattgagttctgcctccaaagcacacacccagcagagaagccccgagaaagtgctgggcccagctaagcaccccagatcttgtgcccagggacacacctggacctcccagacaatcctgggagggattttccaggggtgtggagttcgtggtgaggcagagccagccaacagaagaacgcatcagtctgattatgtagttagtttagaacccaacccaatttcgggagtccctagctctgggagattgctcccacctttgtcaccaccaaaatgcatcatctttcttccgtttctctagtgttgtgtgtatgactccgatttgtgatgtatcccccgccacctggagaggcaaggaggtctgtcatccacctgggaggtccggctgtccagggcgggcgtcacctgttgggggtgccaataaagatgccgcctaagggaaccacatcctgataatcatgttctgagccatgggggaaccctgctgcactccagcctcagactctgggacaggttggagccccagtgactctcacatggagataggacatccctctgggggacattgtgagccacaacctcaaccccatttgggctggggattctctgttcccagggtcctgtgtgaaccgcagctgctgaatggtgtgcagaattggaagagttatgatcaaaagccagttcctgtgtgaatttaagggtgctgggtggttagtccaggggcctactgagaacttgtcctattcttttttatttttatttttgacagagtgtcgctctgttgccaggctggagtgcagtggagtgatcttggcttactgcaatctctgcctcccaggttcaagcgattcccctgcctcagcctcccgagtagctgggactacaggtgcacaccaacacgcctggctaattttttgtattttagtagagacagcatttcaccatgttagccaggatggtctcaatttcccaacctcgtgatctgcctgcctgggcctcccaaagtgctgggattacaggcgtgagccaccgtgcccggcccgaacttgtcctattcttgaccccacatgaacagaaataagaggtaacaggactgtctcaaataacctcaacctcatatgcacattaatgtgaatttttggatgccctgaaaggcagattttatgtgcagaaaagattatccaggggttttcttaagttttaaaaattaatattcaatttattaaagttataaataaaaggaaaaacctagtttgtccttacacttttaatttcagcttaaataacttattattttaattatagatctagcaaatttagcaatcacttctaagaaggctctgattaattttggtctcatttacgaacttaaactcctttaaacttttcatattgcattattcatcacatataatatatttgcttaacttcctaagtataattggctgacaaaccttcttaagtgctgaagcaattcttataaattgaatgcatttagcatataaatatgagcttgaagtctgactggctgttccagtactacgtgtaaaagagcaaatcccaagtccagatcatttactcagttacacatttaaaattgtaatcttgaggcaatctattattttaatagactgagttctcttaaatattataagaatataaaatagaaaaaacaccttaatataaaagatggccaggcgcggtggctcacgcctgtaattccagcacttgagacgccaaggtgggtggatcacctgaggtcaggagttcgagaccagcctggccaacatggtgaaaccccatctctactaaaaatacaaaaattagccaggtgtggtggcgcatacctgtaatcccagctacctgggaggccgaggcaggagaatcacttgaacctgggaggcggaggttgcagtgagccaagattgcaccactgcactccagtctcagcaacagagcgagactccatctcaaataagtaaatacataaataattaggattttgttctttttacatttctgtacgtaattcaagtcttcctgggggtaaaaactacttactcactaagggaataattcagtcatttcaaaccatttttgagggtctctactcagcagtttgatgttgtgtaatgattcaggattcttctctgtgaccctgatgggccattccgattcctatttatagatgcttatctcaagaccttctgtgtgggtagtctcagagcccttgggactgccttcgtccacaaccttgggtttgagtcatatcactaccgaattcttccctctgttcatggaaatctggtaactacatcaacgaggtattttctacagaactgattgggttttttgtttctttgcctcataagatataaaaatgtctaaaggccctggaatgtcacagtattaatagctgatgtgtatggaaggcctactatgtactgggcataattctatgtgttcttcatttgttaattcactcaatcctttttttttctttttttttttttttgagatggagtctcactctgtcgccaggctggagtgcagtggcgcgattatattcacctagaagtttgtgaacactgttcctctttcagtaaaatccatgttatagatgctgctggattttaggcatccagaaaggcctgagattggcagctatttgttgacaattcaatgggtataaaaggtaagcacttaagataaccaactattagaagactgagaatgacggtggtggggagtatttgggggacaggggagcaatacattctggtgatgtcattttggttcattactcagcaaattttttttttttgacagagttttgctctgtcgcctatgccaactcagcttgctgcaaactccgcctccagggttcaagcgattctcctgcctcagcctcctgagtagctgggattacaggtgcctgccaccatgcctggctaatttttgtatttttagtagagatggggtttcaccatgttggccaggctggtctcgaactcctgacctcaggtgatctgccagtctcagcctccaaaagtgctgggattacaggcatgagccaccatgcctggcctgaattaatattgttaaaatgtccatactacccaaagcaatctatagattcaatgcaatctctatcaaaatttcaattgctcctctttaagtggaggcctcaggcaaaaataaataaatacataaatacatacatacatacatacaggaaaaaagaaaaaaatccaatagaattcttcacagaaatataaaagaaaaatcctaaaatttgcatggaatcaaaaaaggccttgaatacccaagcaatcttgagaaagaataacaaagctggaggcatcacactcctgctttcaaactacatcacaaaacaacagtaatcaaagcagcatggtactggtataaaaagacacatagacaaatgaaacagaatagagagccctgaaatcaacccatgcttatactgttaactaatcttttacaaaggtgccaagaatacacaatgggggaagagtagtctcttcaataaatgtgttgggaaaactggatatccacatggaaaacaatgaaattggacccgtatcatacaccacacacaaaaattaactcaaaattgattaaagacttaaatgtaagaactgaaactgtaaaactcttagaagaaaacaaagggaaaaagctccttgacattggtgttggtaatgattttttgtgtaggacaccaaaagcataggcaacaaaagtaaaataaacaagtaggattacatcaagctaaaaagcttctgcacagcaaacaatcagtaaaatgaaaagataacttatgaaataggagaaaatatttgcaaatcatatatctgataaggggctaacatccaaaatatataaggaactcatacaagtcaatagccaaaaaataaataacctgattttaaaatgagcaaagaaataataatagacattttttccaaagaacacagcaagtatatgaaaatgtgctcagcatcactaatcatcaggcaattgcaaatcaacactacatgagctagcaactcacacctgttagaatggttcttttgaaaaagacggagatatcaagtgttggctaagatgtggaggaagacaagggaaccctggacactgttggtgggagtataaattggtacagccattataggtaacagtatgaagtttcctcaaacaattaagaatagtgctaccatttcatccaagaatcccacttctggatgtatagccagataaaatgaagtcagtatcttaaagagaaatctgctccatcatgttcattgcagcattattcacaatagccaagatatgggagcaacataaatgtccactgacagatgaatggctaaagaaaatgggaaatatatacacattggaatattattcagccataaaaaaggaaatcttgccatttgtgacaacatggatgaacccacagaacacaatgctaagagaaataagccagacacacaaagaaatactgtatgtctcacttatatgtggaatctaaagcacacacacacatacaggtaactatgtgaggtgatggatatgttaatttgcttggttatgataatcatttcaccatgtatacacgtatcagtgtgtcatatatcaaatcatcgtgttgtatacctttaatatgttcatttttttgtcaattatactaccagttttctcaataaaactgggaaaaaacgaaacaacatatagtaacaatggcaaaaaagaagccagtaaaatatatcctatcattcaatccaaataatcaatggtggagctgactgtaaattttaagaaagaggaaagtagaaacatttattgagtgcttgctttttttttttttgagatgaagttttgctctgtcgcccaggctggagtgcagtggcgcgatcttggctcactgcaagctctgcctcccgggttcacgccattctcctgcctcagcctccggagtagctgggactacaggcacctgccaccacacccggctaattttttgtatttttagtggagatgcggtttcaccgtgttagccaggatgatctcgatctcatgacctcgtgatccacccacctcggcctcccaaagtgctgggattacaggcgtgagccactgcacccggcctgagtgcttgctttaagtcaggcattgttctaagttctttctgtacctgtatcatctcatttaatcctcagagtagccatgtgaggttttgtagtactatcagctcaaattagtcttttaaacgtttatttatttatttttgagacagggtcttactctgtcacacaagctggtggaatcttagctcactgtaacctcgaactcctgtatcatcccaaatttaaacgagtcaaacggcagttaaaggacctatccaggatcacagaactaatgaataacacaatccagatccagacctgagcccaggctgtctggttccagcacctggttctcaacctttgcagtgtagtgcaatttttaccaaagagttcctgaaatgaacgcaacataattaaaaaaaaaaaaaaaggccaggtatggtggctcacacctataatcctagcactttgggaggccaaggtgggtggtcaggatttcgagcctgaccaacatggtgaaactccttctctactaaaaaaatacaaaattagccgggcatggtggcatccacctgtaatccgagctacttgggaagcggaggcaggagacttgcttgaacctaggaggcggaggttgcagtgagcagagatcgcgccactgtactccagcttgggcaacaagaggaaactccatctcaaaaataaaaaataaaaaaattttaaaaatcacagatggaagctcgagctgattttaatgaaacctctgtgaagcagtgagggaaaaagttgtgctaaaattatatcatttttagagcagagaattttatacatattgacaaattctttttaaacttttcaaaaatgctaacagctaattttatttatcccaaaatgggaatcactttgtttctcttgattataaaaatgatacatagtcatggtaaaaaaaattaaacactccataaagtccaaagaaggtaaatgtcattctaattcccactacccattgataacctgcggtgcagtgtggtgaatgacctagacatctttttttttttttcaaatatgtacacaaatgactctgtgtatatcagatcggcatgtgggtgtgtgtataggtgtatccacctatctccatgtcaagaaatatagatcttgccaggcagtggctcatgcctgtaaccccagcactttgagaggccgaggagggggtggatcacctgaggtcaggagttcaagaccagcctggtcaacatgatgaaaccccatctctattaaaaatacaaaaattagctgggcatgggcgcgcctgtagtcccagctactcaggaggctgagacaggagaatcgcttgaacctgggaggtggaggttgcagtgagccttgattgcaccactgcactccagcctgggtgacagagcaagactccatctcaaaaaagaaaaaaaaaaagaaatatagatctccattatccctttaacagtgcagagtaatccactgtatggatgtgacattattcatgtatataatcagaagttaatggatctaaatgtactgttttcagttttttgaaattacagacaggctgcgatgaatatccttaaacacatgtcttcatgcacttgcccagttatcttcttgggataccgttggtgggatttagagaaaaatcactcacattagggagggtatatactgctgactttgacccatcaaatccagccatggattctctgcaaactgaggggccacccagctccctgaacagtggtcttattctgctgggtccttgtgagggcgtagcatagcctcacatcctaaattaaagtcagttcaccggctgctgctcgggtaactggcgagagaaaagagcctttgcctctccgcagccggggaatttccaaatcctgaaattgtcctgtccagacacagtaaatagtttggccacaacaatctctgcatccacctccctcccatctgtctgggctgggcatgcccgtaatgtttttcattctgtgacaggcttgagcatccttttcttaaaggagacaaaggagataaaagggcctgggctcagaattttgcaagcagaacacacggaggttgtgccaagacagagatggtggctcgatggccagctaattcttgtttatccaacaagccatgctagttgctggggagacccagagaaatgagacacagtccctgttcatgggggttagctgtgtagtagagttgatagacccatggggccatggagcgggtgttggggatggggcagaggctactccattatcacagacttcagagtgtctttccagcaagactagccacacagtctgcctttaaagtcccctggtaagtcactcaaaatgatattttcaagtgcctagcatttacatcttctgggtgttggggattgacatctgttatcacaggcaatggcgcttttattatcattggaacaggtggatggggatgtcagccctcctctggcaggaccaaagcactggccatctgcaaagggaggacatttgggtgtcctcggacttgggcaaaggtgcaccctaggctttagagagcccaaaccaattttcctccaaatgtcctctatacctggtttttctaggttagggttcaggacccaatctgcttacatccacaaatctcttttaatttagaacagcctctattttcataccgtgaattgaaggaattaagctactgtccgatagaatattctgccttctagatttcactgattggtttcttactgtgagtttggatagttctgtcttgtctaacatacctcactgagtaattcagaaggagaaagcagaaaaaaacaaaagtcagtgagcatagaaaagatgagagatgagaattatggaattacaaattttacttaatgggaatttccagaacatttcaccaagtaactgcagacattacattactttcaagcacgtctggaatatttatgaaaattgaccatttatcttgccaaaaagcaatcttttgttaatgccaaaaggatggattgaacaaacaatattttctgaccaccatgtacttcaataagaaataaataacaaaaaagcatagaaataggaaaaacctttaaataattcatgggtaaaaaaagaaagcataacaggttttagaatatgcttagaagcgaacaataatgaaaattccacgtatcagaacatatgagaggcttatgatataggagaaaaaggctgaaaatcaataagccaaacatttaacatgagaagttaccaagagaacagctgagtaaatcctaaacagtagaaaaaagaaaatttacaggtaagagcagaaataaatgaaacagagagcaatcataaaattgacatgacgaacaaagccaaattttgtttttttgaaaaaactaataaaactggcaaacctttggcaagactaattaggaaatagagatgggacccataaagtatagcagaattgaaaggaaattggctgggcgccgtggctcacgcccgtaatcccgacactttgggaggccgaggcaggcagatcacctgaggtcgagagttcaagaccagcctgaccaacatggagaaaccctgtctctcctaaaaatacaaaattagccgggcgtggtggtgcatgcctgtaatcccaggtacttgggaggctgaggcaggagaatcgcttgaacctgggagacggaggttgcagtgagccgagattgcaccattgtactccagccagggcaacaagagcaaaactccgtctcaaaaaaattaaataaaaataaagaaaggaaacatgacttcgatgaagaatcaattttaaaaatgtaaaaatatgatgcaactttatgccaataattttgaaaatgtaaatcaagttgcacaaattttacatttaagacattttaaatgtaaacgatgttttaaccatttaaaaaattgaattggtgactaaaaatcttcatatcaaagaaacagcaggactagacttttttttttaaacagaagggttttaccaaacatttaaggaatgaatactttcaaatacaaactattccagcaagtagaaaaattaccaatacttgctaataatttttacaaagttggcttaatctgcttgttatcccaaccaaagactgtttgaggaaggaaaatatagaacaatcttttccataaacaaaacatcagtaaactgaatccaagataatacatcatgaccaaattggattagagtacactagaatagattagaaaagtaagtacgtaatttttcacattaacagatagaaggagaaaaaccataggatcatttcaataaatgcagaacaggtgtttgctgaaattcaacctctatttatgattaaaaaactaaacaaattaagaatataaagaaacgcttttaaactaatacaggatgtctttttgttatttatttgtttattttatgagatggagtctcgctctgtcacccaggctggagtgcagtggtgcaatcttggctcactgcaacctctgcctcctgagttcaagcgattctcctgcctcaacctcctgagtagctgggaattacaggcgtgcgcccctacgcccagctaacttttgtatttttaatagagacagcgtttcaccatgttgcctaggctggtcttgaactcctgacctctggtgatccgcctgcttgtcctcccagagtgctgcgattacaggcatgagctaccacgctcagccataaaagatgtatttttttaaaaattccccacagtgaagactttagtaaatattaaaatgttaagatcagtaacaagccaaggaaacttactctcaccattctattaaacattaaagtatagtagggccaggaaaaatgaatgaaggatacaacattgggacagaagacacaaaactgccataacttccagataatatgattactctctctcattgtggaactgcctggaacagtgcctggtgtgcagtaggcactcgaaaaatatttgttgatcattatgttgtgacttactttatctcaagttattttatttatttattttttgccttgaagccttctgtttcttcccccctctgaatactgaaagatgtatatgtgcttttttttcttctttttttggagacgaagtttctctcttgtcgcccaggctggagtgcaagatcactgcaacttctgcctcccgggttcaagcaattctcctgcctcagccacccgagtagctgggactacaggcatgcaccaccacgcccaggtattttttgtatttttagttgagacggggtttcactacgttggccgggttggtctcaaactcctgacctcaggcaatctgcccaacttggcctcccaaagtgctgggattacaggcatgagccactgtgcccggctgatcctggacttttgttgttgggaagcattttagtacaggtgcaatctctttacttgtaagatttatgtgcagattttttatttcttttcaaaccagttttggtaatttgtgtgtttctaggaatttgtacatttcatctcggttacctaatttgttggtgtactattctcccataatcctttttatttccgtaaggttggtagtagtgtccccgctttcatttgcggttttagtttttggcattttttcttttttccttagtctagctaaagctttgttaattttgttgattttttttttcaaatatcaacttttgattttgttgattttctctgttgtttttctactctctgtctcatttttctccatgttaatcttttatttttattatttccttctttctgctagctttctgtttaatttgctcttctttttctaattccttaaggtataaaattaggttattgatttgaaatctttcttttttgatgtaggcatttagtgttagaaatttccctttgagcatcacatttgcagcatgccattaaatccttgccttttaacaggaaagtttaattaattcaaatttattatgattacctatatatgaatttatgactacatcttattgtctcatttattttttttcctgttgtttataacttgctcttttttggactgttttgaatagatgaagatttttctcttatttctgtttttccactttgttggtttggaagttttatattctgtttttattctctcaatgactaccctgcaatttatcatatacattgcagccttgaactcctgggctcaagtgatcctcctgccttggcctcccaaagtgttgggactaaaggcatgagccactgcatctggactatcatatacattctaatgttaaccaatctcttttctctattttatcttacctgtaacagaaattttacgtttattttgcttcctttgcaaactttatattatggaaaatttcacatctatacacaagtaaaaaacaatatagtgatatgggtgcagtggctcacacctgtaatctcagcactttggaaggccaaggtgggtggatcacaaggtccagagatggagaccatcctggcaaacatggtgaaaccctgtctctactaaaaatttaaaaaattagctgggtgtggtggcgcgtgcctgtaatcccagctactcgggaggctgaggcagtagaattgcttgaacccagggggcggaggttgcagtgagccaagatcataccactgcactccagcctggtgacagagtgagactttgtctcaaaaaaacatatgtgtgtatatatataatatatgatatatattatatatataattatatgtaatattatatataatacatatatataatacatatataatatatatagtgaacacccatgtaccaattatgtctccaacaattatcaatattttgccaattttgtttcatctatttccttatttttctttttttgttttctatattattttaaagtagatctcagatatcatgtcatttcacctgtaaatacttcattatgcatctttaactcagacattttgtttttatataaccactgtctaataattacattgtttctatcattcaatattcagttcatatacaaatttttctgtttcaaaagcatcttttcaggtttttttttcagatcaggattcaaacaaaggccacatattgcattttattgctgttccttgtctcttttattctatagggaaccttgttttatttccatgccaccaatttattaaaaatctggtcattttggagaggcatgtcctacattctggatttagctgattgcttccttgtggtgccttcttcttctatcccctgtatttcctattaaccagtatgtatgtctagctagctaaattaggttcagatttatttacttaggaaggaacattcacaagtgatgctcttacttcctgtttcatcacatcataaagcatgtaaggtctggttgtctccattttttaaatgataattttcataaatggtttcaggtgctatcagcctaatctcttccttatgaagttccctattcatctttcacttaacggattggttgttcattggtgatcattggctacatccatggtttcattagggattgtaaaatagtgatttcctaacatttttctgcatttagtagctgaaattcttctataaagaaatttccctcatgcactatttggttactgttaaatcgacccatcttagtaaaaagaaaaaacccaaacaacaaagaacccttcaagttggcttctgtgtcctttgacgtgatcccagcagtctgtgatagcttcctttttgtctaacacaacgtattctaggcaatttttacaattcctgccccagacctggaaccagctgttatgttaagaaacgctagttcctttaggggaaaatgatacttagagaccacaatctggggactgaggagtgatcattactagtgtgttttcatgccttccaggattttcagtgcacatattaggaaatgagtgcattctaaaagaaaagagttatgagttcatactgatatttccaattcaaatttatgattacaagagtttaactcaaaatatttggtttaatacttgtatatttttttctttcactgaaaatcttggtttttgttttgttttgtttttagagatggggtctatgttgcccaggctagggtgcaatggctgtttacaggcacaattgtagcacactacagcctcaaactcctgggctcaagcgatcctcctgcctcagcctcccagtctataggtgtgcaccaatgcactcaactgaaacttttgtttttttaatgagcaaacgtatgtattatttggcttatcctataatatacctataggtattccaaaattaaaaatttcaaaattgctactaacaataagaccctgaatatagttcaacatttctatgtagttcttattgtctttagaatattttccactaggaatgtacacttaaaatactgtgttttaaagtaacatgaaataattttttaatgtgtctatgctactaacttgatgtattttagtttagcttgtttaaatttgttttcaatttttagggatttttttctattttgatttcattttattttgtatttatgtaaaatttgttttattttaaagtgaaaactgtaaaacaaggtgtcttcacagaagtctcctttccatcctactttaccctgtttactgccttcctcttcacattgtatagatttttggtttggtttgtcctcaccttgcattgctccctttctggagacacatatttttctttttaatcacatataacacttctttatcaacttgatatatcagattttgtatgataacatcagggttttaggctataaatccaaattattctcccaagtagtattattaaatccaaaaccatcttgaatctttacctaaccccctccacatacacttagaagttttttttttttgtttttttgtttttttgttttgagacagaatttccctctcttgcccaggctggagcacagtggcaccatcttggctcactgcaacctccacttcccaggttcaagtgactctcgtgcctcaggctcctgagtagctgggattacaagtgtgcaccaccacacctggctaattttttttgtatttttagtagagatggggtttcaccacgttggccagattagtctcgaactcctggcccacttagaggaattttattttaaaattatttatttgttttttgagatgtagtttcactcttgttgcccaggctggagtgcaatggcgcgatctctgctcaccgcaacctccgcctccagggttcaagcaattcttctgcctcagcctcccaagtagctgggattacaggcatgcgccaccatgcccagataatttttgtattttagtagagatagggtttcatcatgttgcaggctaggttttagggagaggttattattattattattattttcttttttgagatggagtctcactctgtcgcccaggctggagtgcggtggtgtgatctcagctcactgcaacctctgccttccaggttcaagcgattctcttgcctcagcttctcaagtagctgggattacaggtgcccaccaccaagcccggctattttttgtatttttagtagagatgatgtttcaccatgttggctaggttggtctcgaactcctgacctcaagtgattctcccacctcagcctcctaaagtgctgggattacaggcatgaaccaccccatcgggcccacttagaggaattttaaaaagactgcttaaaattttggagtgccatatggttaatatgtgaaaatatttaggtttgccctaaaatcttctaatttatgggtgaaaatgcatgcttcactccatatgtgtttgtgtttatattttaattgcaggtaatcctaatgtaaaacttctaatttattaaggagcttttgataaaaccaaatgcctactgattcatgtttaaaattcaaatttctcaaagcaattatgaaatatgcccatattatacttatttaaaaaactaaaaataataaataattattgaaagaagctattgtacctttggttctttaccccaaaagttcaagtggaattttttttatagatttacataattttcttttcttttatttatttatttatttatttatttatttatttatttttttgagatagagtctcgctctgttgcccaggctggagtgcagtggcttgaccttggctcactgcaatctctgcgtcccaggtttaagcatcctcccagctcagactcccgagtagctaggactacagatgtgtgcaccaccacacatgactaatttttttttatttttattttttgtggagacggagttttgccatgttgtctaggctggtcttgaactaccggagtcaagcaggagtcttgcctcagcctcccaaagtgctagaattacaggtgtgagccactgtacctggcctagatttacataatttccgctacaaccgatttctaaaagacagtaggctttataattgtatcacatttccattgtagtatacttcaattgtggttctatgatcatatatttgcagaaggttttgcctatttagttttagtgcaaaaattcaggtttttgcatggaagcaggctgtgctatacctccaattcccaattttgtattttgtagtaattgcacttaaccttacggaaactaacaaaattactaagctttaaaattcagattaaatttaaaatgttggctttcattatacattccctataactgtaatttagaacacataccatctctcaaatttgaaaaaaatttagaaaaacaacaaaatttatacatgctttacagagtcatacctgagatcttgagattatcttttaaatttaatacaccaagctctttccttgaggaaaagttttctatccataaaataatctgaaatcagagttgcttctaagcaaacacacttaaatttcagctatctatttagtgtcatctagtagagtaggattctttattggaaatatgaacaatttacctctatttttggctgcaatattctgagtttaacccgaggaaaaaaaatgttcattttgattaatttttgatttttcagatattccacttttagtagacaagtgaaatgctgtcgtttcagaccttttattttttaaatgtgatattctctttattaaatgtataaactcaaaatcctagttatttttgagatttcaagttcattttacactttgtattattctaagaagagcacatgcttggttccatttacaaccactttaatctttaagttgcatttataaatttagcatctttaatttccttcactactattttaatggcctgaccacaatagtggcatgtgacctgagaccacaaacttctctcttcctttcctgtatctctgaggtaaaccgatcatcccagctgcagtatcagccaaggagtagtgtaaccgagtatcccagcctcgaaatgcattttaaaacttttttttcctttcttgctttcagccttgaaacatactttgaaattctttctctttttcccaccaggtgctcccgtgcacagtgctgacttatccgattatgtgcttgcttagaaatttcagggggcagttttgcaacaagccaggcagagagacccagctgttgaatcctcccgctcaagggaagttaggaagttagtccaccaccactgggctgaagacaggatgacacaaaccagacctccagatgggtgattacttgagatagctatagaacaagacatgcagacctgcattctcctgcaccatgcccgcatattttctacacctttttccttcttaaatcccttcactcagcccagaaggcagagacgtttccctttgaagcttgagcccagccatggtcccatctgctagcatttgaccaatagaagctgctttcctttcaccacataccaagcttctcatgctttgactgctgagcggtgagcagctgaacttgagctggttacagacttggtgcctgagtgaggaggtgtgtgttctgagcagctcagcctgtaggcctggtttccagcgagtggagcagttggccaggcagtggaccaaggcttacccactgatggtaccaggcagggcagggccatttgcaaatgctagctatgctagctacttgtggccagtggaccctgcgactggggccttgggaattcccaacagatgcagagactgcctttgtttggggtattttcctttgcctccttttcatggcatcaggtgctatcatgctctgatggtgtaaggaaagcagcattcagtaagttgatggccttcaggactgggtaagtcaaccagagtgcacctggagttgtctgtctctgccatctgggctgtccagccacctggacctagcataggtcatcttggtgccatctgagcctccatgctatctgcacctaacacaggtcactctgtggtgccctctgggtttgacacaagatctcaggacttttctccagtctctcctctttggggattggtatggagtgctctgtctgcatgggatctgtctgtgtttgtgtctctgtttagtgttacccctttctccaagggtgctttggactagtctccatcccacccgccaagactaggtcagaaagcatcaagataggctgcttctctcctctgcaggggagaaagtttccaatatcctagcctctaattttgtcatcctctctgagacctccagagtatttcctgaatccatgtcaaggtttgtggggggagaaagcaagtcaactctcttttctagacaatctgagactccacctggttacatattatggccaacttttgtgcacattttaagctgatgggcaaattacagtaagggaaattcagaggtcaaatggttaacctgcaactctacagttaagcagagtcttctaaggctctctacctctcttttcttttctgccttctttgaatctgctgttattcagctactggtgttgagataaaacttactgtttccacattacttggagattttgtttttcttatacatttcagccagttctagctaaaatggaaacactagaaactcacttgaaactgcagaaaaaagaagagtaaaaaggttttcaaaaccaaactgccatagaaactactttacccaaattttggttcacagatttccttaaattggggcaaacagctttccttagccatgtgaacaggttccaatttcatcagaaaaataatttggatccagctatcttttataaagtggtgagtctgtactgctatcttatggctggagttccaaagtaaaagctattggatctttgtgcatgtaggtatacatgtttagatatgcttgtgtgtacatacatgtattatgttgtatattgtgtctagcatgctaccaaattggattataagtaaatgagtactcataaattaaataagtccagatgcttttcaaattcacatgaatctttggtaaataaaactaaaattattgatagaaatgtcttcaaaattgtcagaatacatttttgtctgagttttttaaccaaatggttttatatttgtctctgtctacatgttaaggtgtcagagtttcacataaaggttataggactataaacccaaacaaaaccaaaattatctttgtgtaatttttttttgacaaaaagactagattgttggtttaattaaaacagctgaatcttctgagttattggcaaaatgtgtttacgtttaaggttcttgggtgttcacctgctattcagacttttaaaatggttaataaataaataacttatttatttatttatttatttatttatttattttttgagacagggtcttgctgtgttgtccaggctggagtacaatggtgcaaacttgcctcactgcaacctcctcttcccaggcttaagtgatcctcccacctcagtctcccaagaagctgaactatggctgtgtaccaccacgtggtaccagctaatttttgtatttttttgtagagatgaagtttctccatgttgctgaggctgaaataaatttaaataatgactagatttgtgtaacatctcagttttcagaagtaatctagataaactgttaaaaatggaaaaaattgagtacatgtaaatgagataaatgcttgtaagtggacttcttgtataatttaaaatcttgacattattttgaattaaataatagatgcttttttggatgtctgggtcatttccaattaagaaaaaaataatgtgtgaaaacatgttataatgttataatatgggaaaacgtaatattatggaatggtttataatattatggagtagttgtttcatctacaaaatgctaatatctaacaaacagttcaggatttcttgcttcataggtttttactaaaatttaaggttaccaagaataaaaattctaattaatatataatcgtgtaagttgtgttattgaaaactaacacaatacttttatgtaatttgggggttatttaaaagtaacttctaaaagaaggtagaaaggaccagtaagtaggagagagatgttaagaaagttgtggttatgaagatgtgtttttggtaagaaaggttataaagaaaagaaaatgattttgtataaaaatatagcctcatatggtaaatttttgtcctaaagaaaaatgattatttaggaaagagagaagtataggacaagtcagaaattccaagcatgtcatagacggtctgtataagttgcaaaatgttcatgaaggggaatttataaaaggaattttgtgggttgtttttttttttgagatggagtctgctctgtctcccaggctagtgtgcagtggagtgatcttggctcactgcaacctctgccttccaggttcaaatgattctcctgccttagcctcctaagtagttgggattaagggtgtgcaccaccacacccagctaatttttgtattttcagtagagtcggggtttcgccatgttggccaggctggtctcaaactgttgacctcaggtgatctgcctgcctcgacctctcaaagtgctgggattacaggcatgagccaccacgccaggcctataaaaggaattttgtcttgtggttaagttagctatgattaaaagggaattatttatgatagtatttctaaagaacagtcccctatgttaaaatggggctttcttaagctattgatttgctcttattaaaattacaagaagatttgctttttaattctataaactgtttcttttgaaaacttcttagattaatatcttaaaagttcagcttttgttgtatctcactgcattcagctttttctccctttgaaaaggcctgagatgataactctccttcaactttgtccatcaacttctataattttttcccctctggatctaactgttgtggccagatgctgaaatgttttatcttagaagtctgtaaaagcagtggtttcctccagtataacttgattctgttgtcttggcttttcttgatatgtctaaattttcagttaatcaggaaacttctcatgcagttactaagagtcatgtattcccctgttatactcatgatcttgaacatactctttctgtgtctaattaaattaaagcactttttttcatcaagtttgacttccaggttatctaagtgggcttcccataaggagaagcagtcacaccgcagaaagtttttctttgcctttttggcaactggctcaagaaacaagattctacattttatggaggtaattcctatgctgtcttttttttttttttttttttttttttgagatggagtctcgctctgtcacccaggctggagtgcagtggcacgatctcagctcactgcaagttccgcctcccgggttcatgccattctcctacctcagcctctcaagtagctgggactacaggtgtccgccatcatacccggctaattttttgtatttttagtagagacgggtttcactgtgttagccaggatggtcttgatctcctgacctcgtgatccgcctgccttggcctcccaaagtgctgggattacaggcgtgagccaccatgccctgcccctatgctgtctttattaggttttgtttgtttgtttgtctttgagacagagttttgctcttgccatccaggctggagtgcaatggcacgatctgggctcactgaaacttccacctcccagattcaagcaattctgcctcagcctcctgagtagctgagattacaggcgtgcaccaccacacccagctaattttgtatttttagtagagatggggtttcaccatgttggccaggctggtctcaaactcctgacctcagctgatccgcctgcctcggcctccaaaaatcctgggattacaggcatgagccatcacagctagctataggtttttgattgcttaaaaaaactgagatttaaaagggttaaggcttttacgcccatttatccttctgtattgcctttaaagtcttttagttatctccttgtttcaatgagtaactactattttacaatgaccattattctgttttgataaaatgttttgagctttttaacatatttgacaaacatcctcaaatcaaatcctaaattaagagcctgacttactgctgaggtttatcaaagctataaaagttaatcactggaagtctgtaaaatctttttacagcttccagtcaggtcatgaactcaagtatcaccaccttcagcctcaaaaaagccctaaaaggtgctattaactaatctttgtgctgttaagttatggggctttgactcctgggtacacatatctcatctaaagaaggcattggctcctgccagtctctgacaccaaactcgagttagccaaagcctcgtctttagacctgggcaaaggagacaatcaaagcaaactgctttcatgagacatcgggataggtttgtattgaaaaacattaagattcatttaataattttgcctctatctgaaataatataatttgttctatgccttgatactaaataatttaaatgtttaatgacctatgaacttcctttcctgttctcctcagaactaggcagggcttatgatctttttgtgtaaaacattgctaattctttatgttttgttttgccttcaaaatttgaaactattcaatccctgcaggcccagggactattgcatgagattttaagggctgattttgagagagaaaattatttcagactctccaaatcgagaactagcacacagatgcctaaacggctgaacaaaatgcttgtgttttgtatagccaatttctacaagtcaaaaatacagtagttcaatgcattgaatttatagagaagtcaattttagaaccttgccttttggcttttggtttttggctcttacattgcttaaagggggtttcccctctggcctagactgtttaattagctataagtcttttgattttaagtccctttgccaaaggggttccactgagggacatgatgaacttggggcagatagcatcaatattggacaaaataaaagcttggccattgatgctacatctagcataccttgacaaaagaggcggaatataaacagaaaaaaaatcctaagcctcccaagagacagaatggacccgttttccctcccccaccttcccccatcttggccaagagggatccgaaaggaacctgaaaaactgttcagtccatgacagaaagcagggggttagacacaccttgctacaccttccccctcctttggaattcaggcacaactgaccatcattaccattaaaatagagatcataaaactgacagaactttgaaattctttgtttccctccatttccccatcaggcgctcccatgcacagcgcttgcttatctaattatgtgcttgcttagaaattccaggggctagtttttaaacaagccaggcagagagacccagctgcagaatcctcctgctcagggggtgttaggaacagttagcccaccaccactgggtcgaagtcaggatgatgccaagtggacctctgtagagcgattactcaagataaccatcagaaccagacacgcacacctacaccccccttttcatgagtcccgcatattccccacacctttttccttcttaaaccccttcactcagcccagaaggcaaagatggtctctttgaggctttagcctggccattctcccatctgctggcatttcaccactagaagctgctttcctcttgccacaccttgcttcttatgctttgacttgtgagcagcgagtagccggacttgagccagttacagtagtgccttctctaacctgttcctcagcagaacatttcaagtaaaccatttttgctccttactagtttctgtaatctcagtgggtgtctccctcaacagaccttgtcatagccccatgtaatggatcagctggtagactgaaaaacaaaaaaaagaaattaccttccttctagttgctgatcaccagggctaggctaacttcttccccttttctaactcttcccataatgctaagcatcctaacctcaatcatggcactattctctgcttagcatccttcaccccattctgtcctccctccctcactctctccttccctctctccctccccaccaccttccatcatggtctgactgtgagttgggggggtcttctgttgatgatactttttcctacttaagaaattgggatacaaggtagaattcacataccataaaactcactcttttaaatggtaaaattaaatgattttaagtatattcacagggtgcaaccatcatcataaataactttaggacattttttgttttgagatagagtctccctctgttgcccaggttggagtgcagtgacgtgatctcaactcactgcaacctctgcctcccaggctcaagcaatcctcctacctcagcctcccaagtagctgagacggtgtgtgcccccatgcctggctaatttttgtattttttgtagagatggggtttcaccatgttgcccgggctggtctcgaactcctgacctcaagtgatctgcctgccttggcctcccaaagtgctaagattacaggtgtgagccaccatgctcagcccctttagaacatttttaacacacacacacacacacacacacacacacacacacacacacacacacacatataaaacaaaacaaaaaaacccaactctgtacccatgagcagtcattccccattttccctagtccccccagccctcagtaactactaatctactttatgtctctatggatttgcctactctggacatttattaaatggaatcatttaatatgtggctttttttttttcttgagacgaagtcttactctgttgcctagagtgcagcagcgcaatgctggctcactgcaacctcttcctccaggttcaagtgattctcctgcctcagcctcccaagtaggtgggattacaggtgcccatcactacacccagctaatattttgtatttttagcagagatggggtttcaccatgttggccaggctggtctcgaactcctgacctcaggtgatccacctgccttggcctcccaaagtgctgggattacaggtgtgagccatggcgcccagcctaatatgtggctttttatgtctggcttcttttactgatcataatgttttccaggatcatcaccttgtatcagtacttattatttatttatttatttatttatttttgtagaaacaagatcttactatattgctgaggctggtcttgaactcctgggctcaaacaatcctcctacctcagcctcccaaagtgttggaattacaggtgtgagccaccatgcccggcctccattcctttttatggctgaataatattctcttgtatgaatgtatgacatttagtttatccgttcctcagttgatggatttattttttctactttttggctattgtgaataatgctgctatgaacattcatgcacagatttttgtatggacatgttttgctttctcttgggtatatacctaggagtggagttgctgggtcatatggtaattctacttcttgaggaactgccaaaatattttccaagaggctgcacaattttacattcccactagcaatgtatgagggttccagtgtctccacatcctcattaatactttttatcatctgtctttgatcattttggccattcccatgggtgtaagtggtatcttattatgatattgatttgcatttccctaatgactaatgctgagcatcctttcatgtgcttattgaccatctgtatatcttatttggagaaatgtcttattgtgtcctttgcccatttttaaattaggttgtctttttgttgttgagttgtaagagttctttacatattctggatactagacccttctcaggtacatgatttgcaaatattttctctcattctctgggctgtcttttcactttcttaacagtgtcctttgacacacaaaatttttgaattttgatgaagcccctttaatctatttttctttgatcgtgcatgcttttggtgtcatagttaagaaacgattgtcaaggccatgcatggtggttcacgcctgtaatcccagcactttgggaggccaaggcaggtggatcacttgaggccaggaggtcgagaccagcctggccaacatggcgaaaccccttctctactaaaaatacaaaaattagccgggcgtggtggcaggtgcctgtaattccaggtacttgggaggctgaggcgggagaatcacttgaaccagggaggtagaggttgcagtgagccgagattgcgccactgcactcagcctgggcgacagagtgagactccgcctcaaacaaacaaacgaacaaacaaacaaaaagaaatgattgccgaatcctaggtcatgaacgtatacacctatgttttcttctgagaaggttttacacctttagctcttatccaatcctatctctttaccattcttctcccattgtttctttatcatcttttttattaaatcaacttatctttactttccttcacatcatctcaaatcaaaacttccagaaacttgcttgctgcttcccagcttttcacagtagcttgattccaacaccatgggtttgtttccaagtagtcttctccccacaccccatatccttgttccttattttcagttcatgtaagcgcaatgacacagtgacaagctcacactgccttgccagcatccacactgggctcctgcaaaaatgatctttatggtcacttgctgtgtccgatgatgtgaaccaacctaggccaatttggccaagccaactcctagctttgttttggtagatgttgtttaactgttaaaagtttgaggtcgataaggaggtgtgtctatgtatgtagcagaatctggagtgggggaagcaagtagcacctccttttccacctcaggacactctcagacaaaaactgagtttaacaccaaaagactctcgttttagaactaaaacatgcttatcacagtgactgcgatcactttgaaacacttcatcatagatagtgtgtcccagtggtcggctggcatcatattagaggtggatttcagaggaagggaccacttttgctatcatatctagaacaatacctcaggcttgctaagaagtaaatttaatgtcagaaatgagttttcactgatgaaattaacaacttgttaattagtatgatgactcttaacgaaaagctctaatggttaaattaaagatattaatttccaaatttggatattttaagggattttttagttactgagttctagtttaattacattttaataagagtatatactctgtatgatttcaatccttttacatttattgagacatcttatgccccagtgtatgtctaaacttggtaatgttccatgtacatttaaaaaaaggtatattttacagttttttgatgtagtgtcctacaaacgtcatttagattaagctggttgatagtgttgtttaaatctaccacatctttattgattttttttatccatttgttctatcaattactgaaaatggagtattaaaatctccaactctaattgtgttttttctgttttccttttagctttatcagcatttgtggaatgcagataaagcaattcttagagaaaaatttatagctttaaatgctgttattagaaaaggaaagaggtttgaaatcagccatctgtggtttcattttgattatatagaaaaagaagagcaaattaaacctaaaatatgcaggaggaaggaaataataaagataagagtggaaatgaaataaatagaaagcagataggcaacaggccgggccggtggctcacgcctgtaatcccagcactttgggaggccgaggcgggtggatcacgaggtcaggagatccagaccatcctggctagcatggtgaaaccccgtctctactaaaaatacaaaaaaaaattagccgggcgtagtggcgggtgcctgtagtcccagctactcgggaggctgaggcaggagaatgacttgaacccgggaggcggagcttgcagtgagccgagatcacgccactgcactccagcctgggtgacggagcgagactccgtctcaaaaaaaagaaagcagataggcaatagagaaagacctacaaagccaaaaattgcttctttaaagtgagtaataaaacttctggctcaaaatataatattgaaaaacaatgacatgtaattcaagaaggagtaaatcagtggtaaagtattctaaggtcttgaaattttcagaagggggtagaataatatattaattttaaaatttgttatatatacatgcagagcctcaaagattatccctaaaaagaaaagaaatggagcatgtaaattcaaaacagtataggaaataggaaatacaaataggaatagggaaaacaaataaaagaagcccaattagtaaaacaaaaaacaaaaaaccaagaaagaaaaacaaagaagcatgaaaaaaatgcaaaaaagaataagatgatagaggtgcgttaaaaaataacaataatcacagaggtgtatggactaaacccaccagttagaggacagagattttcaaaatggattacctctcccccatccaactttctaagagatgtattaaaagtcaaagaacggccgggagcggtggctcacgcctgtaatcccagcactttgggaggccgaggcgggcagatcacgaggtcaggagatcgagactatcttggctaacatggtgaaaccccgtctctactaaaaatacaaaaaattagcctggcgaggtggcgggtgcctgtagtcccagctactcgggaggctgaggcaggagaatggcgtgaacccgggaggcggagcttgcagtgagccgagatcgcgggactgcactccagccggggagatagcgagactccgtctcaacaaaaaaaaaaaaaaaaaaaaaaaaaagtcaaagaacacagaaagcttgaaaataaaaagattttttaagtgccaagaaagcaagtttatgatatcaacatcagataaaaatattctttttttttttttttttgagacagagtctcgctctgtcgcccaggctggagtgcagtggcacaatctcggtttaccgcaagctccgcctcccaggttcacgccattctcctgcctcagcttcccgagtagctgggactacaggcacccgccaccacacccagctaattttttgtatttttagtagagacggggtttcaccgtgttagccaggatggtctcgatctcctgacctcatgatccgcccgcctctgcctcccaaagtgctgggattacaggtgtgagccactgcacccggcccagataaaaatattctttaaagaaaagtcattactaaggatagagagggtatgtacataaagataaagtattttaattcaccaagatgataaactaatttaaaacttgtacatatcttatagccttaaaatgaataaagcaagaatcaacagaaaaaagaaaagaaacccaagaagaacttgacaaatccaccaccattatggaagattctaacatatttctatcattggtagatcatgcagaaaaaagaacctgtaagagtgtaaaagatttgaacagtactgctaaccagcttgattgaatgctcatttatagaatgttttgcataagaattagataatacacattcatttcaaactcttgtggaacatttgtgaaaaatgaccatgtattatgccataatcaagtctcaataaagaccaaagattgaaattatacagatcaccttctgtgattatattgcataaattataaatcaacaacaaaaaataaattattaatacatttggaaatgaaaatgttcactttttatacagtccattagtcaaagacaaaattctaatggaaattagaaaaatgttaaactgaaagatgatgacaatatcacatattaaaacttctcacatgcaattaaaatagtacttagagaaaaattgatagccttaatttcatacactggaaaacaagggagactaaaaattaatgagcgaaccatctatctgaagaagttagggataaaactgcagcagaacaaactcaaagaaagagaaggaagctaattactattgtctgaatgtttgcatctccccccagaaccacatgttgaaatcctaacccccggtgagttggtatcaggagatggggcacttggaggtgagtaggtcgtgagggtggggccctcatgaatgggattagtgcctcttataacaagaggcacaaaagagattatctgtgtctgccatgagagggcatagccaggaggcaccctctatgaacctgaaagtgagccctcatcagacactgaatctgttagagtctttatcttggacctcccagcctctggaacagtgagaaataaatttctgtgtttataagctatccagtctatggtattttattataacaacctgaacagactaagacagaaataataaagggtaggccaggtgtagtggctcacacctgcaatcccagcactttgagaggccgaggtgggtggatcgcttgagctcaggagttggagaccagcctggtcaacatggcaaaataccatctctactaaaaacacaaaaattagttgggtgtggtggcatgtgcctgtagtcccagctactcaggaggctgaggtgggaggagtgctcaagcacgggaggtcgaggctacagtgagccatgaacgcactgctgcactatagcctaggtgacagagtgagatccggtctcaaaaaaaaaaaaaaaaaaaaaaaagagagagagagagacaatagcttagtaagtggcataatccacctttctggcttctcagcatttgtatacacaaatctgactttcaaataagaggataggctgggcgcggtggctaacgcctgtaatcccagcactttaggaagttgacacgggcagatcacttgaggccaggagtctgagaccagcctgaccaacatggcaaaaccctgtctctaccaaaatacaaaaattatctgggcatgatggcacacacctgtaatcctagctactggggtggctgagtcaggagaatcgcttgaacccaggaggcagaggttgcagtgagccgagattgtgccactgcactttagcctgggcaacagacagagactccgtctccagaaaaaaaaaagacaactctatgtttacacttaacaggttgcaactatccttcatgcaaatgaagacattctcagtctttccccaaaatggggagatgcaaagattccaacagcattgtatccatctccggacaatgttaataacccctcaaatccagtcacagtgccggctgaatattccgttatctaaatactgaattggaaagttaacttccaagaaaacttatcaaaaaataaataataggaagggagagaaagaaggaaaaaaagtggttaacatatacaaacacatacacacacacaaacacagcaaacgaagaaagaaaggtacacaactgctacagtccttgtttctgtaataggccatgtggctgaagttgacattccaattctgtcttccactcttccttgtacatatcttttgctctcaactggctaggcctctttgcctgatggagtgacctaaatcttcatcctgaggtgtctggatccttagtggtcctgccttttttgactgtcatgttttttcacttatttttatggttggacatggaagtcctaaggggcatcctagagcatccttgggggttcagatgtggtcctccctacctccactgtgtggcagcaacccaatttctccttgtaatagggatcagtcgccccaggcagtagagtaacccctttcttctctcggttcagtggcatgaagattcccaatggccagcagcagtcccaacatccaattcaatggagctgcagttgtgtcctctggtggcaggattcctctcttgggagccatgaccatgacctccaaacctgcagagctcagagctgtggagatgggaagaaagattctgcacacaggttattaggtgtgcagtgagaggagccactcccatgtctatctggaattccatattctggtgataggagagaaagcaccacatactaatttctgatccaaagcataaactgcatcctgttgatagaagtcaaatcctttcaagttcttctttcaccctggacgattctctcttgagagatcatttatcataccagaaatctggtatggtaaagcagattttggaggcaaagacagggaggtgaggcctgaggcttgagacagaaagaaaagaggaccgtagagagaaggcacacagaggggcccagactttgtgttgttcatgtccttgagtaaggggttaggagggataagaagagtcaatagaggagttcttataagaagaacagaattgccacatgcattgctataaaaacagagtctcaaggagagagggtcagcacttccaggcaccacaggttagccggcagagaaggatgagcatggctctgggcatcccttgctagggcacccattctctgtgaactcttgtgcctgaatctcattgactggctttcgaggcttaaagcagaaaagcaccgtgtaacttggcttaggaattgctcttagacaaatctatagatcctggtctcttaacatctgctttccccggaagccagcagtgggagctcccctttctccactgatgggtccaaatggaagcgttcctgggtatttttggttctcagccccatcttccagcctggaggggagggttgtaacagttcacaacatgagcactggtgaaaatccagttactccagcagcaagagcacaacctatgagaggcaggggggttctgccctcagactggctcttgcatagggagagaagaccttgtgctgataggactcacctgtttggcacaggaggcacccatcagcgctgttcatggtcctgaactacagctgctggtctctctttttttgtttttgtttttttttgagatggagccttgctctgttgcccaggctggagtgcagtggtgtgatcttgactcactgcaacctccgcctccgggttcaaacgattctcctgcctcagcctcccaagtagctgggattacaggcgcccaccaccatgcccagctaatttttgtatttttaggagagatgaggtttcaccatgttggccaggctggtctcgaactcctgacttcaggtgatccacctgccaaagtgctgggattacaggttgagacaccgcacccggcccagctgctggtctctattgcattctccttccactttccatagagtcagtggtgacttcagtccagcctctcccaagaattgggaatcaagttagcaaggacgtgagaggagaggggaacatggctggaatcctttggagaataatgctgctgagacatttgcagggagaagaaaatgggactttttcttttggtcatctttgacaaagttttacaattaccaagacctctgagaagctgggaagcgcatgacaccactataccacatccctctgctggcaagttcatagaaggggatggagacctaggactgtgaattccaggagtgcagggtccatattggactcccttatcccttgtcagtgtacaaggcaggcattcaataagtgttggttgaactgataagatgttgggtgtaagagactaagtacaggaatacctcagagatacggtgggtttggttccaggccatcacgataaagtgaatattgcaataaagcaaggcacacaaattttattgtttccgagtacatataaaagttatgtttactctatactgtagcctattaagtgtgcaatcgcattattctaaaaaagtacataccttaaaaatattttattgctaaaaaggctaatgatcatctgaaccttcagtgagttgtaatcttattgctggtggagggtcttgctttgatgttgatggctgccaacagatcagggtggtggttgctgaaggctggggtggtggtggcaatttcttaaaataagacaacaatgggctgggtgtggtggctcatggctgtaatcccagcccttttggaggccaaggtgagtggatcacctgaggtcaggagtttgagactgggctggtcaacatggtgaaacctcatctctaccaaaaatacaaaaattagctcagcgtggtggcaagcacctgtaatcccagctacttgggaggctgcggcaggagaatcatttgaatcttggaggtggagactgcagtgagccaactgcaccagtgagccaacgccactgcactccagcctgggcgacaagagtgaaactctgtctcaataaataaataaataaataagacaacgatgaagtttgccacattgattgactcttcctttcatgaaagattctctgtagcatgtgatgctgttttatagcattttacccacagtagcactcctttcaaaattggtgtcaattctctcaaacctgctttatcaactaaatttctataatatttaaaatgctttgttgttatttcaacatgttcacagcatcttcaccaggagtacattccatttcaagaaaccactttctttgctcatctataagaagcagctcatcattcactcaagtttgatcatgagattgcagcaatgcagtcacatttataggcttcacttctacttctagttctctagctatttccaccacatctgcagttctttcttttactgaagtcttcaactcctcaaagtcatccacaaaggttggactcaactcctttcaaactcctggtagattgatatgttcataatggcacctagaatgataaatgcttttcagtaggtttcaatttactttgcccagatccagacttgaaagctgaaaggactccttggtccatgggctgcagaatggacattgtgttagcaggcaggaaagcaacattcatctccttgtgcatctccagcagagctcttgggtgaccaggtgcattgtcaatgagcagtaatattttgaaaagaatatttgaaaagaatatttttttccgagcagtatatatcaacagtgggcttaaaatatccagcaaaccacgctgtaaacagatgtgcagtcatctaagctagagcactggcagagtagatttagcatcattcttaaggaccctaggattttcagaatggtaaatgagcattgacttcaacttaaagtcaccagctgcactagcccctagcaagatagtcagcctgtcctttgaagcttcaaagccaggcattgccttcccctctctagctatgaaagttctagatggcatcttctttcaatagaaggttatttcatctacatggaaaacctgttgttcactatggccaccttaatcaatgatcttagccagatcttctggacaacttgcagctgctccatcagcacttgctgcttcaccttgcacttttatgttatggagacagtttctttccttaaatctcacgaaccaacctctgctagcttcagacttttcttccgcaacttcctcacctctctcagccttcatagaattgaagagagctagggccttgctctggattaggctttcgcttaggagaatgtcatggctggtttgatcttctatccagacccctcaaactttctccatatcagcagtaagcctgtttcactttcttatcattcatgtactcattggagtggcacttttaatttccttcaaaggcttttcctttgcattcacaacttggctaactgcatagtggaagaggcctagctttcagcctatcttgtttcttgacattccttcctcattaagcctaatcatttctagcttttgattgaaagcaagagatatgtgacagttcctttcacttgaacactgagaggccattgtagggttattaattggcctaaattcaatattgttacatctcagagaatagggaggccagggcagagggagagagatggggaacagctgttggtggagcagtcagaacacacacaacatttatcaactaagtttgctgtcttatgtgggtgtggtttgtgatgcctgaaaacaattacagtggtaacatcaaagacactgatcacagatccctgtaacagatataataataatgaaaaagtctgaaatattgtgggaatttaccgatgtgacacagagacctgaaagtgagtacctactgttgggaaaatcatgccaatacacttgctcgatgcagggttgccaaaaaccttccatgtgtaaaaaaaaacacagcatctgtgactcagtaaagtgaatcccaattaaatgaggtgcatctgcactcaggataagttatgctttcatccctcctctaaggagagcaaaagggctcaaatttgaggtccaagtatgtgtcaggcatttgatattagggtctttcacttaattctcataggagatttatcacaaatttcccaatcaagattcagcctcatagaagtgagcctcctgagtgagactctgtggctcctaagtggggaatctagggctcgaacccaggtcttgctgatcccatgtttttctcaccatcactggatacttccttcttatgcaaggagagaaatgcaaattctacaaaagaaaaatgggcttgtggtctagacaagcatcttggttaatgtctgagggtcatgttaaaagcttagaaagttagttttgtctgctgggcatggtggctcatgcctgtaatcccactaccttgggaggccgaggcgggcggatcacctgaggtcaagagttcgagaccagtctggccaacatggtgaaaccctggctctactaaaaatacaaaattaggtgggcatggtgtcatgtgcttgtaatcccagctactcaggaggctgaggcaagagaatcgcttgaacccaggaggcagaggttgcagtgagctgagattgcaccattgcactccagcctgggcaaaaagagcgaaattcaaaaaaaaaaaattggttttgtgatggcagctgttgctaatcagggtatggagtcaggagcttaggtctagggttgagctcagatctcgacatggaccaggcttttcccctgtctcagtgcctcatttatggttcagtttcaggcagcaaaactaatgaatgatttccaaccacagaagccgtcactgggagagccaataaagatacgacagatctggcaggagaacaagatccagcccaggtgatggggtgtgaggcttggtcttagctacaggtaggtcgtttcccttagctcctggatgactcagcttggcagccacccagacttctatcaggacccagaggtgctgccagctctggagccatgtcaggccagctttctccccatgtcaccagggaatggagatttttctggtctgctggggcttttcctaattctgcacggtcggcttgagactgtccacctgttgctccatctaggctgcgttgcccttatgagccgtcttcacaaggtacgtttggaggatgtcaggatgtctttcaaaggatttgtagacatgctttaaagtacttacggagtcaatgtcccctttgcttcaagcttctctcctactgtaggaaataatgtctacggtggcccatttccaaggcaaagtgcctcaaataggcttgggcccacaacctgcggatggacaggatatactagacccctgctggtcagggcccccttagttacccccacccaaagcaaagcgtttagtctagaatgaaagtttactagcctgaaaaatagctcactttatctattcttatcagcttgcctggccacctgggtcataagtcaaatacttgaagagcaccttagctgactatgattgcagtgcattatgggccacaacaaactgcagcgagacaaccctaaagtaaacacctaaaagccccaacccaacgaccaataggtgatgtctgggaagatggtgaccccatggtactcagcctatgaggaaccgggggagggacttgcctactaggggatacattgcttgttgtaactgtactgggtgtgcctgcctaccagacaccagatcttgcaagactgtcattaaaagtctcacttctggctgggcgcagtggctcatgcctgtaatcccagactttgggaggccaaggcaggcagatcccctgaagtcgggagttcaagaccagcctgactaacatggagaaacccccatctctactaaaaaaaaacaaaaacaaagaaaaaacctacaaaattagctgggcatggtggtgcatgcctgtaatcccagctactcgggaggctaaggcaggagaatcacttgaacccaggaggcggaggttgcggtgagccgagatggaaccattgcactccagcctgagtgacaagagtgaaactctgtcacaaaacaaaacaaaaacaaaacaacaacaacaacacaagtctcacctctgcaattctctatgtctctaagttcatcctttgggtttggacaggtgagcatgtttctcatattacccacactggtgggccccgtaggcttcctggttggtccaggagtggatgcctgatgcaggctgcacaaatcagattctctcttctggagatttagaatcgagaaccagtggttatcataggttagccttggctgtcagacctggaaggtgaggagacccagagctgagggtgcccttttgggacaggtgtcaaatccttgtacaaacagagaaaccagactgacaagggggtaggatgaaggagctgaaggagaagcagagccacagaggaccgggcagagagaggggctgccttggtggggacagcctgtagacagcgccaacgacgtggggctggtgctgtccccactgtggtctcaaacaccagactagtgcccggtcagcacagagttcaggacagtggtgcagctgacacccagaaagacaccgcagtggaaagcctggcctgacgctcccagctctctccctgccatgcactgactccatgtcctgtgaggaggaggtgggaggagagttttattaggggaattcatttgtaataattgcctaagtatttgctacttaggagaacatggatctgcaaagggtccatgaccctttgagtcagagtttcactcttgttgcccaggctggagtgcaatggcgtgatctcggctcactgcaacctccgcctcccaggttcaagtgattctcatgcctcagcctcccaagtagctgggactacaggggcacaccaccatgcaaggctaatttttgtattttagtagagacggggtttcaccatgtcggccaggctggtctcaaattcctgacctcaagtgatccgcctgtctcggcctcccaaagtgctgggattacaggcatgagccaccacagctggcctgcaaggggtatttttaggtgttagaagcatctcgaggcatcctttctcaacgtttcacaccacagaccactgaatgggcatttggcacattcatagatcatcaattgtaattcaaaaaaaagtagagtttcatcaatgattttaaatttaaagagagtgtttgaaacattaattatgttctcatatccatgagatcttcatttctttcttcctctctctccctcccttcctccttcctctcctccctcctcctttcttccctccctcccttctctccttcccttcctctcctccctcctcctttcttccctccctcccttctctccttcccttcctctgctccctcctcctttcttccctccctcctttctctccttcccttcctctgctccctcctcctttcttccctcactcccttctctcctttttgctgctgctttgctgtttgctgccatcagggcaggggtggagcagtaagtgggttccacccccagccacaccgtgattggctcaggagtggacacgtgccctgagccagtctaatccatgctaacctcaggaccttcctgggaattgtgggagacagagactctctgttggtccagataggtggggcgtactgtgggcttggcgctgctgtaacaatttttctaccacaggagacgctggtctgaaaagaaggcaacgcaaggaagagaacagagccaaggcacctgcagcgagccagagccagagccctgacatcacaaatgctttaattggttccatttattgtttaatccacttgaaattgaatttctgtcatccccgactggaagtgtactgacctgcatactacctgtgtttcctcacagcaggctgaaaagctgtgccaatattgagctcatccagaattagacgaagtttgtattctttttattacttcctttaaccctgaatcagggtccagaagcattttgttgaccattaactcttctctgtgaataaagcagcatgaggaacaacctcttttattcacagagcaaagctcttcgctgctcagccacagcggcttcaactctggcacgggtcctgaagtgccatttctagcacatgactcacaaagtaaataatctgtaaatgaaaagcctcttatcatactttggcacgaaaaacaaagcgacaagccaggcagcatttttccctcatatttgaaccccacatgcaccaagggctgttttatgccttgcacatgaggagtttggtttgctcaaaagcaaagtattggctaacatgtgtgtgcactagtaattgcatttctgctttgtgtgctctgttatctgatagaggagctttgtcaatatcctttggatctctctccaagcacagtcttcattatgatctgtgagctgatttacggtcttcttggcaattttacgactgatatctaggtgcatttgctaagaggacagcaatttagaatgatgtttctgtagctttagtctcctccgcacctttaataagaagaataatcaattttacattagaaagttattttgtgcttattctggaaaaatggaattggttgctttttctaaagataatgagaaacactttttatggctccagactactatatatcagcattttcattttaacagtaatatatcgaggactaggggcaaatggattgcttgtccaataaatgaaatgttcaagtattcctcactgaacttagactcacaattttcatttatggttgcatgtgtaaaatcaccactcaagaacttgtttgtccttgaatatatagttttgtatttccatagttatattgcagaaccatttactcattatgtttacagtgcccttctgaggatttatgctgccattttcatcattactttgcattttatagaacctctttttagtcattgatccattttggtgaattggagatacagtgtgacatatctactacaataaccatgaaaattaaaaaataacagacataaactataacttgcaagcgagaagccctatgtgaatatgatttattaatactttgttttaagtctctttcccctggttctcacctattgaagctttttgcttttctgtcagccaagaggtgccaggtaggtaaggagcatactgggtaactgtgtactccgtgcccaggcctactcatgcctctgtgggctgggcactgatgcaaacttctgccaggcatggccctcttaagtggacaggggatagaaaaataacctagaaatgatgacaaatgtggcttctttccaatgatcacatctcttcccttttccttggcttacttattggttcagaccttcacaaagaagttgaccaagtgcagtgacaggatgatgtgctggtcatcatcctgtcgctacactgaaacatccctttctccctttttgggcccatggtggagtcaggctttcccgcatcattgaggttaggtgtgaacacgtgatttgctttggccaatgaaatgggagtgaaagtgacacatccctgccaggtacaagctttaacggccagggaacaacgtgcgtcatcactgccttgaccctgtggtcaatgttccagacaggggtctgtgtcagcctgtgtcccttagtgaggactgggtatagactgcccctctccacttcatggatatttaacttaagcaagaaaaaggcttcatgaacttaggccactgagatcatggaggtttgttcctgtagcataacccagcctcttctgtccaaaacaagtgggtacacaaatccaaaaaggacagaaatccctttgcccagttcccttcctgagagctgacactgactggcacccagcctcagccccaagcccagggccctcgtttatagacactcatctgtgtccaagttttgttcttctagttgccattcttccattttctctttgccagtaacacacaaaaaatgagagattttctcagtattggtatggattttcaattaacaacaacaaaaacaacaaaatactcccaatataataattctttttttttttttttgaaacaggttttcgctctggtcacccaggctggagtgcagtggtgtgaactcagctcactgcaacctctgcctcccagattcaagtgattctcctgcctcagcctcccaagtagctgggattacagatgtgtaccaccacacctggctaatttttgtatttttagtagagacggcgtttcgccatgttggccaggctggtctcgaactcctgacctcaggcgatctacctgcctcggccttccaaagcgctgggattacaggtgtgagccactgcgcccagcctcccaataggagtgtttaaaaacactcatttttaaaaacgaggccgggcgtggtggctcacacctgtaatcccagcactttgggaggctgagacgggcggatcacccgaggtcaggagttcaagatcagtctggccaacatggcgaaactctgtctctactaaaaatacaaaaatgagccgggcgtggtggcaggtgcctgtaatcccagctactcaggaggctgagtcaggagaatcgcttgaacccaggaggcagacgttgcagtgagccgtgatcacaccactgcactccactgtgggcgacagagtgagactctgtctcaaaaataaataaataaatagaaactagagtgttgggtctaagggcgacagtggtaattaaaacacaaagatcaacgcactgttcaaagattcccagtgcgcggcgctgctagagtcgctgagtcctcacaaccccggctcgtggcgcgagcctggtgccacccgggcggtggtgggagtgtcgcggcccggggtgggtgggattcaggctgccgggggcgggggggggggttgccgcagagggggctggggagggcggcacccccccattgcccgtcctgggccctgcgtcccctggcgggctgcggccagagcagatggcagcaccggcgctggaggtggcagatccccggggaatgagcagcgggatagatcactggctgcagggcagggggcgctgtgagtcgccctggccgagctgtcggagaggagattacttagcagctggtagtgaaaggagacgcctgggcagattggagcagaacggagactcaaagccgggactggggtgcctgttctcacagtcactgacccccacctgttcgaagactggcaagattctgtgaatatgggggaggaagagccaatgattcccagcagaagacgcaagattctccagtgtcataaactggatagtatatgcagagtatgtggaaaatgctagctgggttgttccccaagcaatgcaaacaccatcgtcccttccctccaaaccatgccttgtttgtaccaaggactgcacagaacttggagtgtcaccgagtgacagaaaaaggacccaacacggcgcaaccgctcagcccgagaggcgggtgtattgtcgtcaaccaacatctgaatgacgcttgcaaactgaatttgccgtgcagggtttccaacagcaggcatgttttccagatgctttgaaatcctcttttaaaaaagtgaataagaggccaggcgcagtggctcacacctgtaatcccagcactttgggaggccgaggcgggcagatcacgaggtcaggagttcgagacctgtttgaccaacatggtgaaaccctgtctctactaaaaacacaaaaattagccaggtgtagtggcccgcgcctgtaattccagctactcaaggggctgaggtagaagaattgcttgaacctgggaggcagaggttgcagtgagccgagatcataccactgcactccagcctgtgtgacagagtgagattctgtctcaaaataaaataaaataaaaaagtatacaaggctggctgaagtggctcatgcctgtaatcccagcccattgggaggccgagatgggtggatcacctgaggtcaggagttcgagaccagcctggccaacatgaggaaaccctgtcgctactgaaaatacaaacgattagccaggtgtggtcgtggcacctgtaattccagctacttgggaggctgaggcaggagaattgcttgaacccaggagggagaggttgcagtgagctgagatcgtgccactgcactccagcctgggcaacaagagctaaactccatctcaaaaaaaaaagtaaaaaaaagtacaatattttaataagccaaaagccaccttttttttttttttttttttttttttttgagacagagtcttgctctgtcgctgagtctggagagcaatggcatgatctcggctcactgcaacctccgtctcccgggtacaagcagttctcctgcctcagcctcccaagtagcttggattacaggcacctgccatcatgcctggctaatttttgtatttttgtagagacggggtttcggcatgttggccaggctggtcttgaactcttgacctcaggtgatccatccaccttggccttccaaagtgctgggattacaggcatgagccaccgcacccagccaccaccttcttttttatacatcttaactgtgcctctcttccttgtattttgtgggtgtcatttgtcttttcacagcattcaaatgtttctgtctatttgacatcagtctgtggtttatttgtagccttaaaagtcagatctggccaggcgtggtggcttatgcctgtaatcccagcactttgggaggctcaggcaggcagatcatgaggtcagaagatcgagaccatcctagccaacatggtgaaatcccgtctctactaaaaatacaaaaattagctgggcatggtggcacatgcctgtaatcccaactactcaggaggctgaggcaggagaattgcttgaaccggggagttggagacctggcaacagagtgagactccgtctcaaaaaaaaaaaaaaaaaaaaatcagatccacttactctgagatattttcccccataacttgttttttctttcacagtgctgatgtgttcaacaacatctgaatagtgggaattggtgaaaaagatcattcttggacccaaagaaattttacatccattccaaaacttgttttatataattataattttaatttataaattttagatttgggctagttttgtattgtccaataattattttgacaaacgatttactttgctttctcaggaatttgtcaactcatttgtctcatttttttctttaaaagttttttttttaattaaagactttttttcaaaagcagttttaggttcacagaaaaatttgaagatgcagagatttcccatatgttccctgccccacacatgcagagcagcagtttttaattttaatcaagtccagctcatcaattattcctttcgtgggtcaggcctttggttattgtatttacaaagtcattgtcataaccaaactcatttaggtttcttcctatgttatctttgaggagttttatacttttgcattttacaattagatctatgatcctttttgagttagtttttataaatggtgtaaggtctgtatctagaatcactttttcttttccatatggatgtccagttgttccatcaccatttattgggccaggtatggtggcttacacctgtaatcccagcactttgggaggccgaggtgggcagatcacccgaggtcaggagttcaagaccagcctggccaacatggtgaaaccctgtctctactaaaaatacaaaaattatccaggcgcggtggtgggtgcctgtaattccagctactggagaggttaaggcgggagaattgcttgaacctgggaggtggagtttgcagtgagccgagatcgtgccactgcactccagcctgggcgacagagtgagaccctgtctcaaaaaaaaaaaaaaaagaggatctttgtgtcttagtctatttgtattgctataaaagaattctcgaggcagggtaatttataaagaaaagaagtttatttggctcatggttctgcagtctgcaggctatacagtaagcatggtgccagcatctgcatctggggagggcctcaggctgcttccactcagggtagaaggcaaaggggagcaggtatcacatggcaagaggggaaggaagagagagagaggaggaaggtgtcaagcttttttaaacaatcagctctcgaggaatgaatagaacaagaactcattcactacctcaagaacagcagcaggtttttgaggagggatctactcccatgacccaaacacctcgcactaggccccaactccaacatcagggatcaaacttcaacacgagacttggctttcaacatgagacttggcaggagaccaagcaaaccataacattgtattccctttgcttttttgtcaaagatcagttgactgtttatgtgggtctatttcagggctctctattctgttccattatctatttgtctatttcaccaataccacatggtcttgattactatagcttttaaatacgttttaagtcagctaacttcaggcctccaactttgttcttctccttcagtgttatgttgctattctgggtctttggcctctccatataaagttcagaatgtttcttgatatccacaaaataacttgctgacattttgatttagattgcatggaatccatagatgaaattggaaagaatagacatcttggcaatatcaagctttcctatccataaacatggaatatcttttcttttcttttttttttttttgagacagtctcactctattgcccaggctggagtgcaatggtaccatctcggctcactgcaacctccacctcttgggttcaggtgattctcctgcctcagcctcctgagtagctgggattacaggcacacgccaccacacctggttaatttttatatttttagtggagacggggttttaccatgttggtctggctggtctcaaactcctgaccttgtgatccacccacctcggcctcccagcgtgttgggattacaggcatgagccaccgtgaccagccatatcttttcatttatttagttttttatttctttcatcagttttatggttttcattatatctatcttgtacatattttgctatatttatatcaaagtatttcttttttttgagtgctaatgtaaatggtattgtgttcttaatttcaaattcacctgctcattgctggtataaaggaaagctattgacttttgtatattaaccttgtatctggcaacctttatataattgcttattagttccagaagtttctttttgacaattctttaagattttctatgtagacaaatgctttgtggtatgaatgtttggatcctctcaaaatttgtatgttaggccaggtgcggcggctcatgcctgtaatcccagcactttgggaggccgaggcgggcggatcacaaggtcaggagatcgagaccatcctggctaacatggtgaaacctcgtttctactaaaaatacaaaaaaagtagccgggtgtggtggcgggtgcctgtagtcccagctacttgggaggctgatgcaggagaatggcatgaacctgggaggcagagcttgcagtgagccaagattgcaccactgcactccaggctgggcgacagtgcgagactccatctcaaaaaaaaaaaaaaaaatatatatatatatatatatatgtgtgtgtgtgtgtgtgtgtgtgtgttaaaaactgatagccaatgcaatagtattaagaggtggggcttttggaaggtgattaggctccactctcataaatgggattagtgctcttataaaagaggccagagggagcatgcttgccccttccaccatctatgaggaatgggccctcaccagataccaaatctgctggcaccttgatcttggacttcccagtctctagaactgtgagcaatacatttctattgtttataaatcacttagtttaagatattttgttatagcagccccaatggacgaagacaatggtcatgttatctgcagacaaagacagctttatttccttgctcctgatctgtataccttttatttcttttcctgtcttattgcattagttaggacttccagtaagatgttgaaaagcagtgtgagagagggggcatccttgctttgttcctgatcttagtggaaaagcttctagtttctcaatttgcctcaattttcacagctggtattttgtcactggctactggctacctgctatgactatttcccctaataagttaagattcgtttcaatacaatgtataactcttgaagctggtgacttttagggaggcattgttaaacaaatgcaaatagtaaatccattttatcatgaaagctgaatttgatttagcatgctcagttgccaactccctttatccataatctccctttgcatggaataattttgaaacctatttgattcaatgttattttttgaagtattttcagtttttgaattcagtgacacctcttcaattaaatttgcctgtctaccaatgaccacaggattggactctaatcttgcaaactatctgaatttgcctagtgcttgtattctgggcaacttgcaaacttcccaagacttctatttgtataatgaaacaggatacagttgtcacactttgaatctgtggttatttaatctgattctggagctcacttgagcacaattagaggaaagactctaagaagatttagtttttttaaaagaatgagccagacatttcaggctacaacagtcaaccctatatagataacaaacaatgtctaccatctcaagcctcccaaagttgcaatgccggggctaccatttgtgctctctgagtggtggctggacaaacttgggcagctaacctttacaatcctacgtgccttccaaatttaaaaaaaaagaaaaaaacaaaacagacaagaattagtgattataaactcatacttgcaggcttgaggtagacgctatcctgcgtgttttgtaaactggtgatattttaccaagggccgaggtaggaggaaatggaaatttggtgtttaatggctacagagtttccatttgggatgatgaaaaagttatggagatggacggtggtgatggttgcacaacactgtgaatgtacttaatggtgaatttgatgttgtgtgtatcttactatacattacttttgtttttatttttattttatttttttgagacggagtttcactctgttgcccaggctggagtgcagtggtgcaatctcggctcaccgcaacctctgcctttcgggttcaagcgattctcctgcctcagcctcccaagtagctgggattacaggcgcgtgacaccacgtctggctaatttttgtattattagtagagacagggtttcaccatgttggccaggttggtctcgaactcctgacctcaagtgatccactcgcctcggcttcccatagtgctgggattacagcgtgagccattgcgcctggcccatgccacacttttttaaaaggccttctgtgtgctgattctgctgcctgctcacccctgtttctgctcctcttggccctaaggccacctccctgaagcaacagcaggttgcagtttctggcctctcctctcccacacctggcttctactcgcctctctcctctgctcggctctgctttctgcctgccatgcctttctcttcctcttcaccttctcattccactcccatctttctgacttaggaactgaacatttgggaatcagatgcccaatgaaaaccagctgtgggagtcatagacggtctcagcccttcccctctcttttcttttcatttgcagccaagtagccattaagtcaaaaggcacggggcaggatctggggaccctggaattaattattgacatttaccttggcttggcccccagcagctttgatgcaaactccacccttgttgggagccccatcccctgccccacaccacccaagagcatttcttttcttttccttttctttttttcttttttctgtttttttttttgagacagagtctcgctcttttcgcccaggcttgagtacagtggcgtgatctcagctcactgcaacctccgcctcctgggttcaagcgattctccctgccttagccttcggagtagctgggattacaggcgcccaccaccacgcctggctaatttttttgtatttttagtagtgatggggtttcgccttgttggccaggctgggcttgaactcctgacctgaggtgatccgcccaccttggcctcccaaagtgctgggattacaggcatgagccaccatgcccagcccttaataatgttttctgatgataaaaacaacactccctcatcacaggcaatttgaaaagcagagaaaagttgcaaaaggaaattatccctattaccacctagagatggtgaatacttgaattttttgtttaaactttgaattttatttcaaattgacagaaaattgcatagaaagaggatccgtataccctttacccagattcatcagctgtgaacatttccccggtatgctttaaccctgtgtttgttctatcaatcatgtgtttctcattcggattataaaattgacactttgctctattctagtgttcctcagctttggtctctttggtgtttgaccacgattatgtgacagatggagcctggccaccatgtccctggctgtaccccaggccccagcctagccctcatttgcaccatggggtgtgatcatccccagctcccgggcaccgtgccatggcaaagtcaggtgtggccatgccagggctgcgggcagcctgccaacaagactgcaggttctgcctttatagcagggcgtgcaccagcgcttcactgttcctgccttctgtccttgtgaccttgtaagataagggcgttgggcaaggaaagtgcaggtaggagcaagggaaatgaaggagatgtgaatgaaatagttcgattcaggtagatctgggcatcaccaggcccgaggaaaggtgtattttcactgatgaaggaaaccatgtttttgttgttgttgctgttgttgtttgttttttgtttgtttgagacagagtcttgctctgttgccaggctggagtgcagtggcgcactctcggctcactgcaaactccacttcccgggttcaagcgattctcctgcctcagcctcccaagtagctgggattacaggggcgcaccaccacgcctggctaatttttgtatttttaggagagacgagatttcaacatgttggccagactggttttgaactcctgacctcaggtgatccgcccgcctcggcctcccaaagtgctaggattacaggcctgacccatcgcacctggccatcgcaccttaaaacatttaagacatgttttaaatgctgaaaccaaatggccaacgatcgtatctaaaagggaagatataatcagagattttgagacatcttttagttccctaggaatggaatcctcctgaaaatatggaagttgagtattctttctttttagttttttcagcgacgtcgtggatacaatttcttcagacttgttctactttattcatgttctacattatcagagattctgtggatgcatcactttaatgacagttataatattttaagcattgttaaattagatggcagttagaataagaacaatcagtaagctggacttaagggttagtagaacactcttctcacagttgacagtgtactcataggaaatagtataaccttggctgaggtacctgctttttgagtcataagatctgaaatagggacattttctgtacatttttgtaaagtttgctgaagtagtttaaaacccattttgacatagtttcagttccacctgaatcagcattctgaaaagaacattccaggggtttcctgaaacttacagagctgaaaagctagtgtgcctcccggagtcaggctggagaagcagatttgggggctgcagcagaggtgtcctggctggggtgaagggcagagccagttcctggagggagggagcccagagaaagggcaggtggccagggctgggctagagaagacctagaaagaggccaggaggagaggaggagcctttaggggaaggagccgagttcaccaccctggaggtcccaggaagcagagaaaaggtgacgctgactcactgctgcaggggtcgggagtacctgggtctcagctctgcccttgagtccatcacgcttcgcctctgtctctgagtctggcctctgcatcttcccgctcccattaccagttttgtttgcattttctgtcccaggaagctctctttggcctctggagctgcgtatatctgtagacagcggaccctgctgccacatggctgggcctgccgcttctgtggcttggtcacactcacatgcacgtacgtgtgcatgaacacgctcgcacacacccacatgcatacacgtgtgcacacatgcatgtacaggcacacacgcacacatgtgcatgcgtgtgtacgaacacacacatgcacacacgcagaatcagaaaaggatcctgcccatagctcaccccagactcccctgggtgtcgcatcttgtaccacccaaagtcagggtgtcccagccctctccaggaggcctttacttcccaggctctgtcattcccagaagcagggggctagcatgtgacaaggagtgctcaggctcaggtatggtcagtctgggcagcagggaccaaatcccagtggaaaggcgcaggccggtgagtgagtgaaggcctggtgtccatctgatgcttccagagggcaggggccagcttggacttatctgcaccacacagggccccagcccagggcttcccacggcatgggtgaactgggtcaggtgggcttcacaaggtgtgggaagagagaagacgctggcctgggaattggccacctggctttctttcctggccctatggagggaagggaaggaacattgaactcccccaagtcaggccctggactgagtctcccactcaaccgtagaagccatcatgctgggaagtggttttatccccgttgaagagaggacacagttccactgagaggtgaggtcgtgatgaatgtgtccatgggtgtgtgcgtgtgtgtgtgggtgtgtgcgtgtgggtgtgtgtgtgggtgtgcatgtgtgcatgggtgttcgcacgtgtgcatgtgggtgtgtgtgcatgtgggtgcacgtgtgtgcatgggtgggtacatgtgtgcatgggtgtgtgcacgtgtgagtgtatgcatacatatgtgtacgttggtgtgcatgcatgtgtgtatccatgtgagtgcattgtgttcacgtaggtgtgtgcatgggggtgtgtgcatgtgtgtgcatgtgtgtgagtgtgtgtatgtgggtgtgtgcatgtgtgtgcatgtgggtgggcgcatgtgtgggtgtgtgcatgtgtgtgagtgtgcatgtgtgtgcgcacgtgggtgggcgcatgtgtgggtgtgtgcatgtgtgtgtaggcatgtattgaggggctgggaagtctagtcaaggtggggatatgtcctggtcctattgaaagtctcactgcagcacctctgtagacactgattgtagggagaagattgagagtcagaaggttctccaccatcccagtgagaggtgatggtgcaggctgtggggacagagattagcaggcgagtagggataagtttggaggtggcattggcaggactcagtgatgaactgggtgtcaggagaaagaagaatcctggtaacaccttgggctggggctcaagctcactgctcgctgggtgaatgctggtgtcctgtgtaaagttggtgaagtctgaggaaaaatacatttttgggggggaacccacaaggaatcaggaatgtgaattatgatgcccatcagatatcgagagtggatgcccagtaggaagtggatgtccgagtctcgggctgaggcgaactccaggaccggagaggtgagtggtgtgcacatggggcgggccgatgtctcctgggagaaggtgggagacacaagtggggaggacccccaagtctggtactggtgtttacagatcctggagaagaggaggagctactgagtgagcagaagagagaaagccgcgggtcaggggtgtcaccaacaatgagagaggaggcggctcaggaagaaagtgtgttcagccgggtcatctgctgccggtggaggggcaagatgagaactgaaaactatctctttctcctggcaacctgaaggtcgctggtggtgtggccaagagcagttttcttggagcgttggggaggggacaggagccagattgcagggggatgaaagtgaacaggaggcaggaaactgggacagaacatgtagaaagattttatatctataaatcatatataatttttttctatgaagggatgccaagaatggaggaaaatgtggctccacagggtggagatagcagtccacgtggcttgctgatgggaaggagcctccagtaggggcgatggtgtggaaagctacagagggaaacccactgaaggagaggccgagccctgagcaggaacagaaggctgggctttgacagggcacagactatggcaggccgcggagtcaggaattgtgtctgtttttgtttgagtctgtatccagctcctagaatagcacctgtcacatagtagctgctcagtaaaaacaatgttgcatgaatgaatatagacaccaaaggaggcagggttttagaggtggagtgaaggtgagtgtgatcttttctgctttttggtgctcagtgacggctgaggtagggtcatgggctgaggactgggaggggattggctgggaacgggtgactgcgggagcagctgtgcaggagaggagctgtgctcactgtgccacgggaatgccaggaggattcatttctcatccactggacaacaccagctgaatcgaggcccatctttccacccctgaattgcagctccaccttggtcatataccagcttcccaaatatccttgattctgtttgtgtgtggcattttcctcatctctatttctgctcctggtgcatatactactcttttgattacggtagctttatagcattcctagtttcttttttttttagacggagtctcactctgttgcccaggctggagtgcagtagcgcaatctcggctcactgaaacctccgcctcccagggtcaagcaattctctcgccttagcctccctagtagctgggattacaggtgcacaccagcatgcccggctaatttttgtatttttagtagagacagggtttcaccatgttggccaggctggtctcaaactcctgacctcaggtgattcccccgcctcggcctctcaaagtgctgagattacaagcgtgaaccaccatgccaagtcagcttccctagtttctgatatattgtaagtaccccctcatttccttcaatcacaattattctgtcacttggacttaaataacccgtttactattttaaaaaaagaaagaaagctaagagcagtcatggtgattctatttgcatttgtgttgtatttctgtctatcagtgtatttgggatattttatgtccgttagtaaaactgttcccttctttcaaaatacaggctttgaaactttgttttctttcaaaaatgtttgtattggagtataacttagagttaattgcaaaagcttaggtttgcagttgatgtaaccaccggccagatggggtggaggctttctccagaatctcaggtggctcatgcatgtcattcgatttgttccccctccactggaaactggtgttctgacttctattatcatagattaattttgcctgtttttgaacttcatagaaattacacagtatgaattcttttatgtgtgacttcttttgttcaatattacttttgtggggttcactgatgctttatatgccaggagttcattcatttttattgctgtgtagtattccattgatggagagagtacaatatatttaccatgtataacatattcacaatatattttaatatatattttaaattataatatattaaaattacattgtatataatttatatattaaaataattttatatattataatatattttaatatatgccattgttgctggacagaccgagttatttcgagtttttggctgtcatgaataaagcgaaatgaacgttctttttttttttttttttgagagtctcgttctgttgcccaggctggagtgcagtggcaccatctctgctcattgcaacctccacctcctgggttcaagggattctcctgactcagcctcccgagtagctggaattacaggtgcatgccaacacgcctggctaatttttgtacttctttttagcagagatggagttttgccatgttggccaggctggtctcaaactcctgacctctggtgatctgcctccctcagcattccaaagcgctgggattacaggcgtgagccaccgcgcccagactgtgaacgttcttatgcagccttttggtggacatagcatctatttcagttggatattataatacctaggagtggcattgctaagtcatggagtagatgcttgtttcgctttagtagctgcaactaaacattctatgctgccccttttatgctaccatcagcaatgtaaaagagttccatccttgacaatatttgatgttgtcagtcttttggattttagccatcctggtggggaggggctagtggtatctcactgtggttttactttacatttctctgatgattaatgaggttgaccacattttcatgggttcacaggccattttgatatccacttttgtaagctgctccttcaagattttggcccattttataatgggctctttttcttactgattttctggagctccttatatatttgggagataaactctttgttaggtagatatagtgcagacatcttttccgagtctatgataggccttttcactcccttactcccttaatggtgctttctgatgaaagtctgtgcttttcttactaattcctggttatagtatcgttttatttcacattgtggatgaggttaaaagttgttgatataacacacactagttaagacaacatcctggagaagggaacacggcgcagaggattttctcctctaggctgcttccggttttcggagtcagtcatactgaccctctggttttagttccttgggtggtttcctcggggaaccactatttcttgatttactagctcttgatggtatctactgccttccctccgcgaatatgagagtttcgctcttataattctccagaacttcccctcccctcctctcccctcctcatgtagttgcatcagtgccctcaggtcccccgtgggcaaacgcccacagcttcaagtgcttgctgaaactcaacaagaagcagaatcacttgactcaaccttgtgaatcagccgctgacacttccctcactcctcttccagcctccctcctcattccatcttgacctctttcactttcgccttcacattattaaggttgagaatgtttatattaattttgtgaacatatctcagcctcccatgtcctgtctatagattgaatctaaatgttgaaaacccagtctttggggtttacatcaccgtacttataggaacgtgcatctcaccaacctcggtcatgatgacttacctctcccgaatcttcctgtcttaatgccgttccaaaaaacatcttcttcatgtggcagccaaatggttccacctttttgattttccaccgatgatgcttacaatcgtgccatgatcttgttggcctcctccttggaccatggctgtagagtgtggaaaggtgttaactcttcaaccttttctgtctgtccagtgtagaaaagggttaacctttccactctgtgagccgccccccatgtttccttttttttgagatggagtctcacttttgtcacccaggctggagtgcagtgccacgatctcagctcactacaaccttcgcctcctgggttcaagtgattctcctgcctcagcctcccaagtagctgggattacaggtgcctgccaccacacctggctaatttttgtatttttagtagagacgggcttttgccatgttggccaggctggtcttgaactcttgacctcaggtgatccacctgccttggcctcccaaagtgctgggattacaggtgtgagccagcgcacccagcttcccccacgtttctaggtagccatggttagtttcttttgcttgcaaccaaagatctctaataggtaaagaaggtgatccaagattccaggaaacaggaaacagaaggaacgtgctgtggggagatgaaacagaagctccgggtgagaccagggcagcactgaccactccacagcacctggctgtgtagctgctctgggttggactcgcctgcccagcatcccttcctctgctgcctttggggaaccgcctctcctttgattgtcatcttgattgatttgtggacaagacaacccaggcccctgccctctccaggactagggccagttcagaacccaaacccaatctgactcccctggagctctgactctgaacaaaataagacaaaaccagaaaacacggtcagagcaatgtggatcccagtggttgagacctccagggctgtgcatgggttcctgctcctggaccctgcactgtcactcgttcttgtgcttcctgagcccagattctgtaatttacccttcaaccccgtgagctctgttacgtttctcgttagctatggtccacttcttttgcttgaaaccgaagatccctaatggatagagaaggtgatacaagattccaggaaacaggaagcagagggaatgtgctgtggggagacagaggcgccacagccccctatcggcgacacctggctccaagcagtttttttctctggttcttaagcctctctcctccccgactcaccctccctccctgaaggtgtcttctctgcttttgcctttgagatggcctcttccttccccttttctggtctccttccctctgggtccctgccctgtccgaggcctcagtgctcccttctctgatgatgcctcccaacgttgactccagctgagcttctcaaagctccttctcctggccaagaacatttggtgtcaccttctaccctgtgctgactccttcctgcttggtcctgtcgccttcctgtttggccttttggtcacacttgtctttcctcagtaggggctttggagcccagcagacctaacctcaagtcgagtttctgccttttctgggctgtgtctttgcacagtggcttcacccgtaaaacgagggtcatgacgcttgccttcactgcaaggagattgtaaaagttaaataggagcctgtgtgtggagtgcagatacaaaaagtgatcaatgttcctctgtaaacaaaaacagagaaaaaaatcctcccacgaccctttaccaccacctcttgtgaatctaaaggtctcttgctgctgtgtttttgagcataaatctgtttattaatttatctctaggtcatttctctcatttccttccttccttccttcctccctccctcccatccttccttccttcctttcttcctccctcccttcctccctctccttctcctcgctccctccctccctccttcccttccttccttccttcctttcttccttccttcctttccttctttttctttcatctcactctgtcatccaggctggagtgcagtggcgtgatcatggttcattgcagcattgacctcctgggctcaagtgatcctcccacctttcagcctcctgagtagctgggacaagaggcacgcaccatcccgcctggctaatttttgtattttttgtagagatgggatttcaccatgttgccgaggctggtctcgaactcctgtgctcaagcgatcagccctccttgacctcccaaaggactgggattacaggcgtgaaccaccatgctcagccctttctctaggaattgtgtgtaagctgacgagatttcagtgtgtgcctagcccatccttttgaaggctagggttgtcggtggttctcaaagagagtccagcctcttgataccttggtcttaaagctcaggaatctcgaagaattaagctccgtttaggccagtcctctgtgttcactccatgttccgctcacaggggctgcttaccacccatgcttcccttttgccctccttcccctctcctgggattggagagctcatggaagcaccgattctgcatctcatcagggcacctgctggggaccactcaggaagggtgtgggaaggtggccttcggccgctggttcagatttgattctgagagcaagggggtgggaagatctgggctctctagaacactgctgtgccattagtctcctgaaagtcacacaggtggcaaatacacgccccaggttgggctgtctctcggctcacctatggggccctcgctgaacagaattgactatgacaagttcaatatcatgcactcagatacctctgcatgcgagaccccttgtgtcatgattgtctctgccattcacagccctccagcctggctgactcctatctgcctttaggattcatttcagggaccacctcctcagggaagccttctcagatagccctgtcccctctgggttgtgtgaaatgccccagctctaagcacccccacctccccagcacattcccctcatcgtgtggtggccacccattttacccagggatgaaactagactctcagtgtcttgaggacagagttggtggctattgatctgtagggagcgaagaaaaaacttccccttcgccctctgaagttttgctgaaagaggaactcacaaaaggcagacaacttggccaggcgtggtggctcacccctgcaatcccagcactttgggaggccaaggcgggcggatcacctgaggttaggagttcgagaccagcctggccaacatggtgaaaccccttctctactaaaaatacaaaaaaattagccaggtctagtgacaggctcctataatctcagttactcaggaggtcgaggcaggagaattgcttgaacgagggaggcggaggttgcagtgagctgagactgtgccacagcactccagcctgggcaacagagcgagactccatcaaaaacaaaaacaaaaaaaaacaaacaacaacaacaacaacaaaaaacagacaaatcggagaaaaggcatgcatgttttatttaacgtctatgatggagccttcagaatgaataccaaaagatacaggggaagtcatccatttttatgcttaatttcaaccaggtatgggcagccatgtagaaatataattggacaaaaagggtttgatctaatgctaatagactgagggggaaatccagcagggcttgtctctctagattcttcttggcctctttgagcaacattccttccttctgggtgtggggcaaggccctctctggactgggagtcttatgacctacagtcaaaataggtcagagaatttcttctttctttcctgcttgcttgcttgcttgctttctctttcttttcttttctttctttctttctctctctttctttctttccttccttccttccttctttccttctttccttccttccttccttcctttcttcctttcttcctttcttcctttctttctttctttcttttctttctgacagggtctcactatgttgcccaggctggagtgcagtggcacaatcttggctcactgcaacatccacctcccaggttcaagcaattctcctgcttcagccttctgagttgctgggatgacaggcacccaccatcatacctggctaatttagatatttttaatagagacagagttttgccatgttggccaggctggtctcgaactcctgacctcagatgatccacccacctcggcctcccaaagcgctgggattacaggcatgagccactgcacccagcccagagaatttctttatgaacagtttttatatagaaaggcagagagaaagttagaataatattttcgggttttatggctggtttggggggaaaagtaatatttttaggttttatggctgtttgcagggtgggggtggaaaggggattcgacttcctatggccagcttagcaagagaatgagactgaggacaaaagggcatgcaaagttcagagaaaagctattgcttctgaggctgcttctcaggccttcattttgagatattgttttctgcgtcccaacacgttctttcactgagttttcccccaaacattgaaaaagcactgaccatgtgctaggagttcaaaaccaaaaaggagggttggttttcgtcaaatgggagatactttcaaaatgtgtggctcatggcagggaaatgagagcactggggactactggaacagaaccgcctggcccgggagaatccaaggaaggcttcctggaggaggaatggcagagcggacctctgctactgcagcaggaatgcccccagctgctgctggggaagggcttatgttggctgggtttgcctttggggcagagtggctggctgctccccctgcccagcgagggtagttctggggagagttgccacgctcggaccccatttcccatcatccccaaccctttgcattggttcttgccagcagatgtgaagataaaaagctggccagacttcccactctccttccgcttctatccctgtgcgctgaggcctccgaggagccctctgaggcttctgatttgcgacctggaggaaattgcccgtgtgctcggaggaatgcctgcatgacactcttgtgtgagagaggaatagacgtcttttgtattaaaccactgcagtgtcggggtttatttgttccctatgcagtgcctcttacttcaccagcacccagcctagcagatcgcttgagctctgaacctctggtggggctgaatggcgggattaggaagtgataccagtctttgaaagtctccctcactgagtcacttgatcctcattcactcagggctcataagccgaatacctggcgctgatgatgcagagatgacactgccctgctcttacaggaggtacaacccagtggagagaacaggcggaaagtccaacagccacgcccccctctctctactcactttcccccagggtcttcctgggctgatgtttcctagagagttgagggagatgttccaagctgagcaggtgaaagggacagtaccagggagagggccatcggccagagaggtcagcggcaggtaggagcagggacatgtcgtaggtggaggagagacattggtcctggggctgccaggggctgaagtgttgatgttaactgccgggatcactgtcagccaatcagggctgccacgtacagttgctcagcctcgcactgctcagggaggatgagtagaggctggcacctggagaaatgtgtctgtacagagcaggggtacttttctctgactatcacaaacatgccaaatgagtcaggtgccctgataccagtgaactcagggtcagcacttaaactcattgcttattagtgatgagacttcacagaagtaggggtgagaagtgggggtgagggtaagaggaataatggagccacttctgctgctgcacatgagtggcaccttcttgcttaagcctcacggcagccatgtgggcaaggggttcttctggtgcgggggagggagttaaggttaggtggcttgcctagatctatattcgggacatctcagagcctcagcctccccgtccatgtaatagcaattgatcgactccctctgaatagggtgaacctctgtcccttttgccctggatggggatgctctaggcctgctgtccctgccatgggtgacagcacccctgtcactcttgaaaaggtccaggttcagatgaaaagtgccacagtgaccctacttccaaggcaaggtatgaggctagaaatgaccaattgccagaaagagcttgccagggcaaaggcatcacctggcaacatagtcagggaagacagggcctgggagggaagcgctggggctgcccagagaggcatctatccaggaagctgcacagaaggggctgagggtgcagctgaaggacaagcacctgaattcaaactctgacctcactcacagagctccccgctgctggccagccctggtcagagggacaggccaggcaataagaggagagccagcagtgagtctccctgttggaaaggggccacacatatgcagtcagggggccttgggagcagccctgtccccaccccttcctgatcccaccccactagagagggagcccagaggtgggtaaagggcctaccatgccccgcgccacttcctcctgtgtgtccttggctacaggacatcccctgcctgagcctcagcatccacatctggaagctgggagtaatgagagttgctcacctagggggatggggtgaaaattaaacaagattctgccggcaaggtccttgggtttgcccacagctcctcacagcctccctctctctcctatctctcacgtccctccctcctctcccgtcattgtcactgtccccagacctcctccctgtgccctctttccactctctcacctcctactccattcaactcccctgcttttccagaatcagggaaactgaaggatgggcctcagtctctaaggaaggcagagacctgggttgagcagcagaataaaagatcttcttctaagaaatgcaaacaggctgttcatcaccatctccaggtgttcacagacaccagcaaagcaatgcactcctgacaagtagattttttaaaaaatcagagtgaattaattttaattaaaaatttatcttatgttttggccgggcgtggtggctcacgcctgtaatcacaacactttgggaggccaaggcaggtggatcacctgaggtcagaagttcaagaccagcctgatcaacatggtgaaaccctgtctctactaaaaatacaaaaattagccaggtgtggtggtgtgtgcctgtaatcccagctactcaggaggcttaggcaggagaatcacttgaacccgtgagatggaggttgcagtgagctgagatccagcctcggcgacagagagggactctgtctcaaaaaaaaaaaattaagtttcaagaattaaattgtatgattatggttaatactctgggaatagctttcgatttattaatgaaatgattgttttaattggctttgaagctacacttctaaaataaaatgttaagaatcttccataatttgttaggtaattgtaccatgaattgcaagtgtgtaaataaacactaggaaatgaataaatgtcattccttttggagtggaccttcatgtggggcaaaagtcacactaactccttctgggatgagaaaacacagctaacccttccgggacaagcacctgaattcaaactctgacctcactcacagagctccccactgctggccagccctggccggaacggacaggccaggcaataagaggagagccagcggggagtctccctgttggaaaggagccacacgtgtagtcagggggccttgggagcagccctgttcccaccccttccggattccacccactagagagggagcccaggtgggaagggttccacatggaggatggactctgcccctggacagcagcccccacttcccaacctcagccatggtgggcactggtgctctcttgcctttccatctgcagagcctgaagcccctgggtccagcctcccggccctggtcaccctggacgacaggattgtccagaaagggcagccttccccaggtctccccttggcaaacttctgctcacatatctggggccaaactgtgccacaacgttgacagtgactatatgggcctgggggaaaataattatttagtggaggggattagaagcagcagtgagaggggatggcgcaggagggcaggaagaagtctggcagccgtttaggcccgaagggaagagctagtagactcagatccatggagagatggaaggaaaggagaagagaggagggaggagaggggcagggcagggctgcaggcaactgcgggaggacaggaggcagtggacacgaaggagccaggaggacaggggcgtgggaacagagggagctggagggaggtctgtggctgtggggaccagcagagctgcctgaggggctgagtagggttcggtcattacatacaacaagatccaggcctgcgaccacgctcaggatccaggctctgcccccacatctgctcctgcagacgcagctctcctgctggtcacctggtggcccccagagggatggctggccatctccaggcactgggcctcatcccagggaggaagaaagaggtcgtggctaagctgtgagtgagccccaggggacagggggcctgggcccttggaaggtggggttctgggggacggtggtccggtctccctgagacccgccctgtgacatgactaactgtggggttctttcaccagggtgagcccctcttgcctcccttacactggcccctttgcccagaatgactgcacaatttttatcacttacttccaatgagtggagtcagggctgttatcaaacccagagacacaagcaaagggcagggcgtcacgtgggggtggtgaaggcttctctggggacccttcaagcctggctgccatgaggtgccagggcaggaagcacactgtccttccttaagctcccacagtgtgcccagcccttgatggaagtctcaatttaattataaatgcaggcttgaggttgccagtatcaatcatctacccaactaatctataaacgagtgcaatcacatttaaaatgttgatagggctttactggaacctgacaagctggtcattgcattcagaggacttggatccactcatttgattttgaaaactacgagagataaagagagttaaggtagaaaatgtcaatacatggctgggcatggtggctcatgcctgtaatcccagcactttgggaggctgaggcaggcagatcacctgaggtcaggagttcaagaccagcctggtcaacatggtgaaaccctgtctctactaaaaatacaaaaattagctgggtgtggtggtgcacgcctgtagttcccagctactcaggaggctgaggcaggagaatcgtttgaacccgagaggcagaggttgcagtgagctgagatcacatgactgtactccagcctgggtgacagaacaagactcttgtctcaaaaaaagaaaagaaaagtccatactattttaaagctataacaattggaagagtgagctgtacaaagtctcaatacagttataaagctataacattcagaagggtgtgtgtaggagggtggacgggtgctcagaaggaagctctaaagccacaaggagaaatttcaccccctttggactggacatgggctgggctctggcaaattgcacaatgcaaggtgctgacattattgcccactaggtcacattgcctaagagtagcaatttataaaatctcattagagagtgcctgtgtaaattctttatttctgggccacccgtgtacttcctcattagtaaggaggagaattaggtgaagctcatggttgtggattgctgcagtttgcacagactttacaaaaagagcttcagctggtgtcctgcccctctagggcactcactggggctttcacgctggcattggaaaagtgggcatcggcaagttccgtggctgaagaggaaaaagaaaagcaagctttcacccgccctgggtgaactgtgaattctaaagtgtgtccccaggaatattgggagacctcagcagtttacacttggtgggttgaacagggtttgttagtatgaattattcatccaatattgaacacctacctgtgcacagcacgcttgcctagtgaagagagcagggctgctgttcctgctctgtgcccgggtgggaggcagacacaggggctgtcatgggagaagctgggctcaaacagcccatgaaaagggacccatgcacaggcacaaaagccccgaggaagaagccagcttggtgcactcgacggagcatcacccacttggctcaacaaatgtgtggtggtatgtgcatgtgtgtgtgtgtgtgcatgtgtgtctcacacatgcgtatttatctacatatgcaagaggataggaagaaatacaggaaaacacttttgtaatcttgtggttgagaaagctggcataaacaaggcacacaatgccagacactatggccttcaggcctccctgccacggggatgctgccttttctgctccgggtgtttccacgaggcaggcatggaatcttccctggacaagcgacataccgtggagagacaggtaagaatttctacacataggaagggtggagcagccatggtcttagatgtgagcccaagggaagacagcctgatatattttactgggccatatttgaaatttctgcacagcggaagacaccatacagtaaacacaggagcctgcgagagaacctctgccgagcaccagtgaacggccaagtgacacgagtgacaccatgagcttggtgccctctccatcccaagccagaggcggaagccaggcccttcctcccagcccagactcctacatcccaaacttgagccatggcacacatgctgggcacttactctgtgcatagcagagggagctgagctgcatccagaaacagacctaggagctcacagacccaaggcctgggtctccacccctggaagagggtggtgccgagagcagggcccccggctgtcactggcccggagctcaccgtgcaggggcagcccaggccctccggggatggcactggggtgtcggaggccaaggagcagaaacagctgtggatgcttccctcggaggactgggtggggccgggaccaccaggacctgcccaccaccttctctatggggcatctggctgtgtctgggagtatcttgtggaagggtcctttttaccatgtgggatcggtggtccagacttgtctgggagccaaggataccaggcatgtcaagtaggctcttccagaaggttttccctcctgggatgtctgtgtctctgcccctctcctgctgcctgcatcaggaagggagggagcagatgggctggtgaagtgagcaatgtcagtcacatgcatggactgtccagggctcattctgtgctgagggtcctcccgtgaatacgtggctcaccagcgtcccaccccatagagaaggtggggggctggccctggcagccagggctggagtgggaggaggttgaccaggagcatgggggtgagggagaaagagagagggaccccactgtgctgccctagcacaagggacactggtcttcctgattcctggccttccacgaggtgggacgcccctccttctctgggctccttctctgccccgcggggtggtggatgcagtagggaccttccacctcaggacctcaggagccgcatatgtggtacacagtgggcctcctcgacagctgctcatgagcaaacaggcccaactccttctggtggcaaagacacagacacacacagacacataagcacacacagacagtgacaggacagaaaggaaccttccccggggtttcccagacacacccagatgtctacctcagctctgccccaagtcagaggattgcagcaattcttaccgtgaagagtgctggggaaaccacgtcatcaaccccgatcctctcgttttcatttctgggttctgacaacagccccagctccaccccttgaaacaagtgaccgaaaaatggacaacatgtagtcactctgggcaaagaggccaccccagtgggggtatgggggacagagggccccaccctgggaggacagcactgtcccctgtccaagggcaggtgcagccacctcctccacctccctattccccccaccctttgtcccccccgcccccccgagcttggcccctttgcttggagagatcctttggttttttcgatcacttgcttctaggctgaggagggcggggctgttgtcagagcccagaatcaaagccagaggagcaggtggacgctgagactgtcccctcaccctgctccacgggcaatgttgaagtgggcatctgggtgtgtctggggtatcccaaggaagggtccttttcgtcatgtcactctgttgggggcggggcacaggagcagggagccctttctctcccgagctcctcagactcccagcttccctgggtctcatctcagagctttgcctatgacctgggagccctgtgggtccaggggaggggactggacgcagccccatgacaatgctcagacctgggctaggaactggaagcctgtggttcctctgggctgtaggggttggggccccacagtgatggcagagccaggacctcatacacagcagcatggactccagacccgagcgggacctccgttctggtcccagggtgacctgggctgagtggcccagcaatcagggaccacttcagggtccctctgcactggtctgtccctctcacccagtctggacccctgtggggcacttgccctgtccccagttttccttacaggggacctgggcaaagcccagggaagcttgcacctgttaaggaggccattctcctgcctcccccttggggatccagtttctttctctcgccttggaccttccccaggatcctatggaaactccagcaagacctggtattttatcacattttcacagttatcgcattgattgttcagccaacattccagggacagaaatgggggaggggctgtccttccccaggaaagggtggaatctccttccgtcttccttacagttggcctagggaaggtgcacactcttaaccacccctgggttcccctgatgccttgaagaccctgccttgccctggctgcagggggaccaggaaggggccagttgtgtctgggacattcctgccgggagagagtcaggccctagtgcacagaaggatgtgggtgtggtcggtgggggcactggcagggggtagggcacataagtccctggggagctcactcagaggttccaggttgtggcccttatggaagttcctgggtccaggggctagagtgagactgttccccgctcatgtctgggctgcagacgcccaaccagtggctccccctgtccacccttggcaagggagggtcctggcctccctctctgctagtggggaccccccaacaccctgtcttctctcctctctggagctctgcctgggtgcatggcttgtacagtgagttactgagaattgaactctggacagtagctgggccccactttgctttaaacattttagtctgaggccttctttgtcatcagatgagaaggttcacagatgtgcagatgtgctgatagtctaacctgactggtttgtaaaactagaaagagaaacagacaatgtgcctgtttctgtgatgggccataaagtggatcttacagatttggagacattctggaagatctggacctgtctggatcagagaggggaggcaggcatgggccagtcatgaatccagtggggcttgggccagctggggcagcagggaggaggacgtgcccagggtgggtgagctggggagaccctggaacccaaggctgaggacccagagccaggagatgcaggagacgccccagggatgctgaacaaagcgctgtcccctgttgcagctctcctgggtctccccatagaaagctcatgtgggggctgtcctgaccatgggtccaggggtgtatttgctccaggggcatttgatgcattattgagccaggggaaaggccatcacactctgggcagcaggagccaccgggaagggttggggaagggttggatcctcccaaagttggtacaagtgtggtctctggcccaggtgggctgtgggtactgcggggcgtccagctgtgcatgcctctggtgtgaactgggaagggtggcctctggtcagactcacacaacacaccaagatgagctcacaccagaaccacctgagactcaaatggcagttgactgcccccaggggacatcttcttgactagaagagtccaacatctggagacagaatgggaggggtcctcacggcagagaacagggcctcttctagtctgtggcgcccaccaaaatggcagggacactgtgctgaggtgggaggattgctggccaaagacaggggggtctagtaagagccagaacaggggagcaggcaggacaggggacagcccctgggcccacagggccagcaccttccaggggcagctgtgctgggtgtagcaggtggacctgggaaaggacggcgccagacctgccgccaggactcaggggctcacttggggcaggagcacagtgtccctcacatttctgcagggcccagaggtgggagaaagggcacagggtggcccttctgacaggggggtgggggtgtgtccctgctggggactctgtttcctgggagggcctggatctctaggtacctttcagagcctttagcatctcctctgggtaatggggatgaaaacactcctccctctagtttacaattattagatacactgatgcataggaggatgcaggacctgctggtctcccatcttcacagccagggaagaagatgcaggaccctaacagagagcacaggatgcagcaggtgccagggagcctggaccaggcacatcctgcactggccacaggggaggacacaggggtggctgtcctggagcctgctctctggaccgctgagtgttattcagggtctttctccagggtgtggacacctgtcttctcacctgccccctggtctcctgccttccagattcctgtggcccacagggagcaaagtgtggccagctctacatccccattgtcactccacagtgtctggtggttcagtggtcagagtgggcacatcaaaaccaaagcttgcccagaggcatggcagagaacttccttgttctgacgctaatgagggtggcacactcggcctgagctggagaaggggtggggcagggtatcgctgactcagcagcttccaggttgctctgatgatatattaaggctcctgaatcctaagagaatgttggtgaagatcttaacaccacgccttgagcaagtcgcaagagcgggaggacacagaccaggaaccgagaagggacaagcacatggaagccagcccagcatccgggcccaggtatgggaagcccctccgagcacctctgcgcctcagcctcctctttgagcttttctgatgagcactcacctctcaccctcaaacccctggggcctctcttttcctcctgaccctctctctggacctggcctcttgctctaggttcccagttttggtcccagcgctggtctctcctccgatggtaccaattccaggtctccttccacctcccggggcaggtgcacagggagcctgaaaatcccaatagataatggtgctgtgccccagccagtgaagacggtcagagaggggattctcctcacttgtctttaaatgagcatctactatttcttgcaaatgttccatgtatctggacttggcctaagccctttttatgttcagtgtcatctcgttctccctaatattaagaaaagggggttgcttgtaggactgcttggctatgaggaagccttgtttcctttttttgagaacacagagcaagtgagtggtagagcccagattcatgcccaggtctactcgaaatggtggggaacattttgaaccttccttccttctttccttccttccttcctccttccttccttccttccttcaattctctctctctttctttcttctttctttctctctctctctttccttctttatttctttttcttctttctctctcttccctccctccttccttcccttctgtgcttccttcctttcttccaatatttccctttctctcttcctcccttccttcctttctctttctttctttccttctttctttctttttctttcattctttccttctttctttcttttacttccttcctccctccttccttcctctctttcttctttcctttccttcctttcttccttccttcctctctttctccctttctccctcccttcctttcttttttctttcttttctttctttcttctttccttctttctttcttttccttcctttcttttttctttctttctttccttctttttcttttccttccttcctccctccctcccttccttccttcctccatctctctttctctttctttctttctttctttctttctttccttccttctttctctttccttctttctttctttctttccttccttctttctctttccttctttctttctttcttttgtgctgcctcccaacagagatttttctaattctgattatgtcaggatgcatagagaggggctgggagaggtcttcaaggtggggctggtgtttccagcccaggagtcctgagctgccccatctcaattgcctgagaagcacatttgggagacctcagggcaccctaagggatgtggaaaatcctatgaattacccgaaaagaagtccctggcaggttcctctccccagtcatccccctcaggagtgtccctgtcccgatgctcggtgtggtaggagttaaccctgcaggcaggaggaagccccagagggtccatctccagcaggggctgtgggtgagcagagccaggacaggggtgcatggtgaggccacagaataagacccagctctaccccagggagaggagcagggtcctcctcggagggcctgagcacactgagctgaccctggggagaccctgacaaggcttagacaggccccagggctgcagtgatctcccagtgagccatagaaggggtcagagggggaggtttggaagtgtgctaagggatgtgcggagcagggggaaggagggtggggtgcaagggaggaagtgtggggagggaggaggaggcagggcagtccaggagggctcttcctcctctggtcttttccctggctgtccacagacacttgatggatccacacatattcacttccaactttaacaatggcattggaaggcataagacctacctgtgctacgaagtggagcgcctggacaatggcacctcggtcaagatggaccagcacaggggctttctacacaaccaggtgaccgacccagccatccgaatccgggcagggcccttccaatccagggacattcataggtagaaggttccggattgtacttgtggtttcctgcagtgtttgtcacttgtgcttcctgcagctgctgctgcttggccctggggttggggggagacttcggcttcagtgactatccatgcccaggtggggttgagtctgcccaatggcaaagtgcttcctgaggaccctcccaggatcccctcacagacacagctctcaccaggaacaattcagcaatgtgggatctgaggactcagggcctacctgacctcacaaggccaggatgccccagtgccctctcctgggcttcatcctgcacggagagagactgaggcaggagaggctgaccagggatcctgtcctgcccagggtggagcccacagcaaggccagaacaggtcccatgtcaggatgcagggatgtccagcatttggggaggagctgggccaggccaggctgaggggccctgagcccgggggactttcttccctggcccctacccagcacagcctctgtctggagagaccaggtaatgcttggctccggtgctggaaactgggaccttctctgggctctatgagctcaatgtgggcctcgctggatccacacacactgcttggaacatcctttcaagggtgccagtctccatcaccgcctaagcagtgggactcccccaggaacgacccacagccccttctcagcacaaaccatgtcatccactccaccctgcatcactgctgatggagtccctccctgtctttgtccccatcacaatcacagtccttgctgccctgctgtccccaacttgaccgattcctagtcttagtggaaaatccttttctctggagtttggagtaaataccatatttctataagtcaaaataatgacaattataccatgtcacagggaccttcccacgttggagtgagtcctgctggtcttctcttccccactacttttggtggaattcattttggcctaagtctatatcacatttgggctcagcacaggttgtggcacagaatagaagcttctagaattatgggccacagatgggatgggagtaggggagttgatgagtagagcaggtcaatctccccttgaaggaagcacactcactcagggccatcaggccaatgacctcggggctccgccggcccctcctccctgcccccatctctgtagcccctccctgcagggctgggtctggggtgagggtcctgaaggctctgaccttgggtacaaaattgatgggggctccaaatgctcagtaattagagaaaacacattttaatttaataattaatgcaatattttaaaacgcaaatttaatacaaatagatcatgatgaataaaagcaaagattttaataaagcctggcaggagagtgctgtcctgtgtatagtggagctggggcaaaataaaacctcattgctcctgatctgtttgtatttaaatgggcaacattttgcttatcttgggatttttgcataacatctgatatttttaatattgcatagaaaatcatgcatcctaataaccggggttttggtgacccctctaatttcgtgctggaggcccccgcctccccagccccacctggtccaggcgctccctccctgttcaccacacatcacctcacactctgtttccttttctaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatggtaagaatggaaggttcaggtggggtggggtgggtgggggcaggagaggttcctgggaagaaaaggagaaaggccttggtctgctgcctgcagaaacgatggctggactctgggacctgactttggggtcgatgggaagagagaggccaggccaggagatgtgggcccagggagggcagggagagtggctggaagtggaagcagaacttggggctttctgaaagaatgagaactgggctggcccagattccaatgggaaggaactgcctgatgaaggagctaagtccctaggggagggagagggaaaggagggactgaaaccaggatgtgggaagtctgtcctgagagtcatgggccctaggtgccaccccgatcccacagcgggagcgtgacttatctcccctgtcccttttcagaatttaagcactgctgggacacctttgtggaccaccagggatgtcccttccagccctgggatggactagatgagcacagccaagccctgagtgggaggctgcgggccattctccaggtgagggcttcctccctctgcccggtgccccatcggcctccccctcctccccactcccctgggccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggcgtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacactagcaaatgtgtagatgtctttccttgtgtagcggacctgtagcggggaaaggtcacacaacatccctctggatccagaaaactcagctaaacctcacaggagaggaacctaaatgcagaccccaccctcactcacagagccccgcccaccctcacttacagagccccgggcgctgattggaagggacaggcccagcagtaagaggacagccagcagccagtctccctgttggaaaggaaccacaaacgtgcagtcaggggccctcgggagccgccctctgtccaccccttcctgattccacccccctagagagggagcccaggggaggccatggctgagacccaggacaggcccagtcgggggaaggagcccagggagggggcaggtgtctaggctgggcccaaagagagggctggggagaggagcagcccaggaggcagagcccagccacagaggggaggggagctgagtcccggggacaggaggctccagaggcagagacggagcccagggctagggcggcaggtgtcagggctgtggcttcagcttggcgtctgtcctgggccttctgcgctggttcccaactctgggatgtgtgacttatatgcctgattacagcggcggctcccacctcacgatttctggaaagtcctcagaagccgcatataagaccaagaacgggcctcacatgcagctgctcctgggcagaaacgactcactgtttccctggcctagacacacacaacacacaaacacacacaagacacacatacacacaacacacacaacacatacacacacaacacatgcacaaaacacatacacacacacacccacacacagtgacagagacttcacacaaagaaacctcctccaggtgccccagagcactccggggcgcaccccagccccgccctgagcagaggactttggcatttcccacgcaggggcgggtgcgggagggaccggcttgtcaaagctgccctttgcttgtgtctctgggtttgataacagtcctaactccacttgttggaagcaagtgatgaaaaacgtgcagtcattctgggcaaagggaccagtgtaggggaggcatgagaggctcacctggtgaaagaacaccagagttagtcatgtcacagggcagctcccagagagacctgcccctcgtcccccagaaccccaccttccaagggcccaggctcctgtcccccgggcctcaactcacagctttgcccatgacctgggagccctgggggtcctggtgaggtgactggacacagcctcatgacactgctgggacctgggctgggaactgagagcctgtggtccctctgggctgtaggggtcggggccccacagtggcggcagagccgggacctcgtacacagcagcatggactccagacccaagtggaacctccattctggtctcagggtgacccgggctgcacagcccagcacctgcccagggtccctctgccctgctctgtccctcaatagtctggacccctgctgggtacttgccttgtcccccccttacaggggaccagggtgaatcttgggcgaagcctgcacctgtgaaggaggccattctccttgctcccatccctgccgcccacatggggaaccagctccttcttgttcctggggacctttcctgggctctggtggaaactccagcggaatgtggggtctttcattttccctcagtgttgcagaggccgaaatggagaggggctgtcactccccaggaaagggcacaatctccttccttccctccagctggcccagggacggtgcacactcttatcctagtcaccctgaggactgcagccctggtatgagcccagagtcacccccaggttttatggatgccttacacactctgccctggcctgacctcaagaggaccaggaagtgcccagttgtcactgggttttgctgccctgagagagtcaggctccagtgcacagaggaacgtgtgtgtgcagggtggtggcactgtcagggggcacagcaatcccaggggagcgtgccctgctgttccaggttgtggcacttatggaagatcctgggtccagaggctggagtaaaatcgttcccactcacatctaacctaccctgggctggctcgtgggagtcaaaggcccagacagtggctggccctgtccatccttggccagggagggtcctggcctccctctgcgctggggggggagccccactcaccctctcttctttcctctctggaggcgctgccctgctctccggcttgtacaatttgctactgagaatttaactccagacagtatttttgccccaatttgctgtaaacatttgagcctgaggccatgtttgtcatcagatgaagtggtttacagatgtgaaattgttgtttgtagtctaacatttctggtttgtaaacccatccgtgatgggctcccagcccaacccgctgcagatgaggccgctgagtttctgttgagaatgaagaccgggttcccaattagggcaactcgtccctcacactgctccttacacccccatcttccagatcccagccaagccccctccacccaatacaccccagcgtccttgcatccaattaacatctcagagtggccacctttgcagagacctggctggggagggaggtcacagtaaagacacagcctggctcctgtgggccccctggggacagcagccctgcacacacactctgggcctttctctccccctttcagccttgtccttggatatcccccaggtcactcttgctcaggaccaagcagattgactggggacagcaaatgtaaccataaaaggggattctacaaggactcccctcagggagcaggtgccagcggtggggactggggagtagataagaggtggctgggagctaggataagagcgacagcccagagttcctggatcctggctgaggctgggtcccgggccccaggacagtcctgcagaccccagaatcagagactgaggagtcaaagacaggcaggagacgcccctggggatgcccagcaaagcactgtcccctgcgtgcagctttcccgggtctccccacagaaagctcagtgagggctgtcgtggccactggcgacccaggcacatttgctccggtaagaggccattgctctgggaagcagcagccacacaggaagagttgggggagggcaagggctctgccctccgagggtcctgcagggcacagggtctgcatagcaggaaccccagactctttgtgccccacccccactctaactcagagctctgtgctaaggagagccttatcatgccctcggtggattcagaagcactttgtagggctgagtgacgaaacatttggggctgggagtagagctggctgggtcaggacgacaccccctcctggaagggcaggcctgtggggggcacaagcagggacaacagcccattcgtgtctgctggtacaggtgcagtctctgtgcaggtgggcagtgggtactgcagggcaccatgctgtgtgtgcctcgagtgtgaactgggaaaggtggtctctggtcagactcacacaacacaccaagatgagctcacaccggaaccacccgagactcaattgggagttgacagcccccaggggatatcctcttgactagagaagtccaaggtctggagacagaatgggaggtggcatcctcatggcagagaacagggcctcctctggtctgcccatgaggagtggtgcccaccaagatggcagggacactgtgctgaggagggtggatcactcccaccttcttctgaggtttccacctcagcgagcaccggccaggctgggagggcgaggagctgtgcttggtccgggtggccagggtgggactgtccccaggatgtggactctcttgcatgagacagctggccaaggatggggggtctaagaggagccaagacaggggaatcagcaggacagggggcagcccccaggcccacagggccagtgcattcttcgggcagctgtgctgggtgcagtaggtggacctgggaaaggatggcgccagacctgccgttgggactcaggggctcacttggggcaggagcacagcttcccacacatttctgcagggctggaggtgggagaaagggcacagggtgagccttctgagggcatttgtgtccctgcatcactctgctcactgggagggcctgggcaagtctaggtacctttcagagcctctcgtatctcctctagaggagtaatggggatgaaagcaccccttgctctagtttgccgtaattagatggactgacacaaacaagggctcagcatgtctgtctccttcccttcccagggcctgggatcaagacccaggacacactctgctctctgcactgcacgccctgcagggccctggatgcagcaggcatgccctgtgctggctatagtaggggacgtagggtcggctgctctggagcctactctctgggggcgctgagtcttattcgagacctttctccagggtgtggatacctgtcctcctgcctgtcccctggcctcctgccttcctggtccctgctgcccaaagtgactgaagtgtggccaaggctcgctttcctcattgtcactccacagcatccctgtagggctattgtcagagcagggaaatcaaaaccaatgcttgtgggaagacacagcagagaacttccttattctgtgacactgatgtgggtggcacaggggacctgagttcaggaaggggtggggcaggtcattgctgacccagcagcttgcggtcactctgaagtgatgtaagcctcctgtgtcctaagagcaaccagaggaggaccacaggagcacatgctgtgaccgtcacagaagcaggaggaccctgacctaggaaccgtgaagggactaggacatgatggctaatggctaacacggtgctgacagccagtcctgcagcctctcgaagcctctgctcctgagcctcctcctcgggttccttggtgatggtcacttgcctcctgccctccaggggctccttctggttcccttggggactgtcctctccccttaaccctctctggacctggcttctgctctaggctcccagccctgttcccagccccagtctctagtctgatgctatctattgagtctcctcctgctcctggggcaggtgtgcaggggggcagcaaatcccaggtgatggcactgtgcccagggggcgaagacggttggagagaagattctcctcacccacctttagagtggcacccaccatttctggcaaatgcaccatgtctcccctctgggctaagctcttttcgcgcccaatccaaccctatcttacccaatattgggaatagggagttgctcccgacaccaccgtgctacgaggaaaagccattctttccttttcctgtgaacacacagagggtaagtggtagagcccagattcacaccggtgtctatgcaaaaccataggcagcactgagatttccctaaggccaggctcattagggttatgtagggtgcacagagcggggctgggagaggcctgcaaggcccagtaggtgcttcctgcccaagagtcctgaggtggcccacctggctagagaagcatggtcgttgcttgtttggcagaacacaggactgttgtggtatccttcattgccgtgttcatgtatataatttaaattaaaatgtaaaattaaagaaaagaaagaaagacgttagagcagccccggtcagccccggtcctgggaggtatcacccaggttgtgggctttgcactcctctcccatatgatcacagctcccctcggccccggtggcccccctgccacgccgccttgaatttgacaatgccacattagaagtcttggtcttaatcctgaatgtttcttttgcccaccttccctttcattcgcccagctgtttcaaccccaaaacgctgcttcctccccttcctctcacttccatatctaattagtaactcactctggctgaattcatccccacaattcacccccaatgtaccctgactgccatcactgtcacctgtcgcctgggatgtctgacagtctccggttcaccagctcagctcccattccctttgcatgcagctactggagtgactttgtttttttctttttttagagataagctctgtctctgtcacccaggctggagtgctgcagcgtgatcatatctcactgcagcctcgaactcctgagctcaggcaatcctccaatctcagcctcctgagtagctgggacaacaggaccatgccaccatgcctggggaattttttgtagagacagggtcttgctatgttgcccaggctggtcttcaaactcctggtctcaagcaatcctccatccttgacctcccatagtgccaggattactggcatcagccacctggcccagctctggagtgactcttcaaaagaaaaaccaggtcatgtcactgtttggtgacatgaaacaacccctaccccaaccacacatggatatgcacatgtacacatgcatgtaggctcacacacccatgtatgcatgtgcacgtgcatgtgggcacatgcgggagggtacacccagttgttgtcttttaaaatgaaatcgaggccgagtgcggtggctcacacctgtaatcccagcattttgggaggccgaggcgagtggatcgcttgaggtcgggagttggagaccagcctggccaacatggtgaaactgtgtctctattaaaaatacaaaacttagctgggcatggtagcaggcgcctgtaatcccagctactcaggaggctaaggcaggagactcgcttgaagctgggaggcagaggttgcagtgagccgagatggcaccactgcaatccagcctgggggacagagcaagactctgtctcaaaaaaaaaaaaaaaaaaagaaatttacatttttcccaatgacccatgagactccctcctcccgtgccagctttgtcaccctctactttttttttttttttttttaagacggagtttctctgttgttgcccaggctggagtgcaatggcacaatcttggctaaccacaacctccacatcctgggttcaagtgattctcctgtctcagcctccgagtagctgggattataggaatgcaccaccatgaccaactaattttgtatttttagtagagacagggtttctccatgttggtcaggctggtctcgaactcccgacctcaggtgatctgtccgcctcagcctcccaaagtgctgggattacaggtgtgagccaccgcgcccagctcctctacttgttttctatgctgtctggctggtgtctgttctagtccaggtcacccagccctctctcgcctcagaccacggcacctgccattccctctctctggacaaagcttccctcggctcttcccactgctatcccttctctccctcaggattcagttcccaagtcacctcccctggcctcttaaagcgagctgcccacacagttcccttctgccccatctccatgtctatttcctgcaccgcccttgttacaaaccagatttatcttccctgtgtgtagattctcatttcttgaccatctgcctccacttcccataaacgcactgaggtcagagtccactgcttcctgcccatgcctcgacggcagtgctggcagccagccttgccccctgggtaggaatccatttacaattgttgaaagaaaaaaaatgaatgattaaaaacagtataaaggaatgagaaaacggtggatggtaatacacaaattattcattagccccaaggagtgggctaggaggtacacagagtggacagtcacatcctctgtgatacctgtttgtattgggctcttgagtaattgacagaatgataacactgccaccagagatgagctttccatgacgaccaaggtggaggagtcagattctgggtgctgcggccaaaatacacgtttcaaaataaatgggtaaagaaattcgtcactggagactgcataaaggttggggcaattgccagagccttgcatggagaatcacacctgcttcaaagatccatttctgtgctacaaaccaccccaccttaaagcttaccataaggtgtattgttcaggcttctgtggatcaggactcagatgacctgtccactggatgagccagcagctggctcactcgtgcagctacagtcggaaggcggccaggcgggctggatggtgcccagtggtctcacttacctgcctggtacttggtgtgggctatcagccaggcacccagctgggctgtcagatgctctccctgtggtcaccccatgcatccagcttgagctccctcaccgaatggcatctgggttccaaaataccaagtctggtcaagactctgcctacatcacacttgctaatgccctgttggccaaggtaagtggtcaagctcagtgttgatatgggaggacgaggctgggcatggtggctctcacctgttattccagcactttggaagaccaaggcgggtggatcgcttgaggccaggagttcaggaccagcctgggccatatggtgaaaccctgttgctaccaggtgtgcacctgtagtcccagctactccagaggctgagacaggaggagaatttgagcccagaaggtggaggttgcagtgagccatgatggtaccactgcactccagcctaggtgacagagcgagatgcttttcaaaaagaaaatatacgtgtatgtgtgtgtgtgtttgtgtgtgtctgtgtgttgtgtgggaagccagtcacaaggatgtgaatatcagggggtgtgtttcactggggatcgccaacatgacagtttatcagtcttccctgtgtgccaatgcatcttactccacccacttgaaaataacccacccattcccaacagccacaaagtatcaccccaatatggaatcatgttcagacatcacatccaagatcctgtcatctaaatcaatcccaggtatagacagggcaccttcagtttgttttgtgggggtgagttgcctcaggttcagagatctgtgctctaaaacacaagtgatctccagctgggctcggtggctcaggcctgtaatctcagcactttgggagggtgaggcaggtggattatctgaggtcaggagttcaagaccagcctggccaacatagtgaaaccctgtctctactaaaaaatacaaaaattacctgggtgtggtggcgggtgtctataatcctagctactcggaaggctgaggcaggagaatcgcttgaacccgggaggtggaggttgcagtgagccgagattgcgccattgcactccagcttgggcaacatgagagaaactccatctcaaaaaaaaaaaaaaaaaaaaagggaatcgctagatggggctgaatatccagggggccttcatcacatgcctggaggcttgggcaggctgtcagctggggtgtttcctctctccacctggtctcgcagcatttaggactacaagtctgttttccttgcatgtaggtgagcaagtcctagatatgcaaaaaatgaaacctacaaggctactcaaagcccagccaaggaaatcacatgacatcatttctactgcattttattggccaatgcaagtcacagaccagcccagatggaaggggacaaaaaaatagactgcatcccttgatgagaagagtgtcaaaatctcatggcaaagggttgtaaaaacagaccggaggaagcgtgaggcgtacactgcacccccaccacaccagcccaagcccttagagaaaaatgatgaaaaatccacctttggccagccacggtggctcatacctgtaatcccagcactttgggaggctgaggcaggcagatggcttgattccaggagtttgagaccagcctggacaacatggtgagaccacctctacaaaaaatacaaaaaaattagccaggtgtggtggcgtgagcctgtagtctcagttatgtgggaagctgaggagagaagatgccttgagctccggaggttgaggctgcagtgagcggtgatcgtgccactgcactccagcttgggcaacagagtgagattttgtctcaaaaaaaaaaaaagtcgacatttgttagagtcacccaagcaagggaagatcagacgaataaggtctcaagtgaacattttctacgtgagcatatccaacccggggcctctgcagggcctgttttctctaggagcaaggactattagcaggcaggggatgggcctggggggcctgggaaagggagaacaggtggaggctccatacagggggacgctggggccaagctcaaggtagggcacacccctccatatcgaagtaggtcatcaagagtcatgcagacgggacaaggcaaggagttccggtgcaagctcgctaggaccctcagtaacaccagaatagaacctggacccaggatccagggcagagagaacctttttaccaaagcctgctgtcaccacccaggctgctttgccttgacagtcccactcctcaactgtaggaaggtgagaaaaattcaacttctcaagtgtgctgttcaggtcacaccctctagagggcgagcatgcagcagaggcatgcggcataaacctttgtccctttcctcggcagggtcccgtgaaagtcaggttgcaggacccccaggccacactggaggagaccctgaagctccactttgtcacccaggagtccgtgccttgcagagcctgggccaggtgctgagaaacacagggatggggctgggctgcacctgcccttgcttgttttttttgttttttgttttttggtttttggtttggtttggtttttttgagacagagtcttgctctgccactcagactagagtgcagtggcaccaactcagctcactgcaacctctacctcccgggttcaaatgattctcttgtctcatcctcctgagtagctgggattacaggtgcacgccaccacacccagctaattttttatatttttggtagagatggggtttcaccttgttggccaggctggtctcaaacttctgaccttaagtgatctgcccaccttggcctcccaaagtgctgggattacaagtgtgagccgccgcgcccggcctgcccttgctttttgggttttgtctttgccacccagagtggcgtcacctggataacatgccctaagactgcagggatgtaggtgagtctgtcccagtccaggaaaccaaggctagtatcagattggctttcatggcttctgggcagagcccagatctgcacctcacgtgtcccggagtcagggaagggtgatactggcttccccagttctgccctctggacgggcgctccgttgacagagaccctgaagagcatcatgccaggtgtggcctcaaatagtaaagataagagaaacagaactcgaggaggagaaatatagaggccaggccaaggccgtgcacagccccctacagcatctggcactgtggtcgcttctttactctgcctccctcctctggagctcccgtgaatgtgagcgtcctcctcctggctggacggcatctcctctctctgggccttctgccctggccccatcctccctcggactgggtgccgagtctcaatgttggtcacttatgaccccaaatcgccttctccagctggacacccccagtctcctgggctggactctgcagtcacctttagtgctcccagctcccctgttcctaagccctgctgtttctacctttgggaggacacgcaggctgtcagcccatgtttgccgagtgctacggtgcttgagtgtgcatagccctaaacagggagctggcactgggtgttatgactccccttgctgtaaactttaaggactcaaacagaagcagaaaaaagtgaaaataagcaacatctactgagtactgaccacccaccaggctccgttccttatgcctgaaggggagcggctcatttaaaccttacacctgaatgggagcgctcattgaacccttgcgcccaaccccacagtgaggagccatcattttcaccttccctgttcagatgaggaaatggactattgcagttagaggttgcaaagccaagctggggttgacccagccaggtaggtctctacccaggtgctcaaacgcagctggggcaattgaaacaagtcttgaaatcagttacagagattctttcttttttgtattttaccatttacctaactttacatgcaacttccttagttcagatacaatgtttcattaaaaaaaaaaaaatctgggctggacatggtggctcacgcctgtaatcccagctctttgggaggctaaggcaggcagatcacttgagatcaggaattcgagaccagcctggccaacatggtgaaaccctgtctctactaaaaaaaatacaaaaattagtcaagcatggtggcacatgcctataatcccagctactctagaggctgaggcagcagaatggcttcaacccaggaggcagagtttgcagtgagccgagatcacaccactgcactccagcctgggagacagagtgagactctgtctaaaaaaaaaaaaaaaaaagtctgctcttctttagagcaagggtccccaacccccgggcctcggatgggtacaggtacatggcctgttaggatcccagctgcacagcaggagatgagccgtgggtgagtgagcattaccgcccgagctctgcctcctcttacatcagtggcagtgttagattctcacaagggcgagaaccctattgtgaactgctgtgaactgcacatgcgagggatctaggttgggtgctccttataagaatctaatgctggccaggcacggtggctcacacctgtaattccagcactttgggaagctgaggcaggagaatcacttgaacacgggaggttgcagtgagctgaccctgccattgcactccaacccccggcgacagtgtgagactctgtctcaaaaaaaaaaaaaaaaaaaaaatctaatgcctgatgatctgaggtggaacagtttcatcccaaaagcatccccctcaccctgtcagtggaaaaattgtcttccacaaaacgatcactggtgccaaggagtttgaggactgctgctctagaggaaatcatacagtgtcctactgggaaactacctttaagaaaggaagttaacgtgttctttaattcacagatggaattttcaaatatttgcaacccaaattattcctattttaaattataaatgcaccagtaaaatgctttttttaaaaaaaaggtttttggctgggcgtggtggctcaagcctgtaatcccagcactttgggagcctgaggcgggcagatcacgaggtcaggggatcgagaccatcctggctaacacggtgaaaccccatctctactaaaaatacaaaaaatcagctgggcatggtggtgggtgcctgtagtcccagctactcaggaggctgaggcaggggaatggggtgaacccgggaggcggagcttgcagtgagccgagattgcgccactgcactccagcctgggagacagagcaaaactctacttcaaaaaaaaaaaaaagtttaggctgggtgcggtgactggtgcctataatcgcagcactttgggatgacaaggcaggcagatcacttgaggccaggagttcaagaccagcctggtcaacatggtgaaacccagtctctactaaaactacaaaaattagatgggcttggtggcatatgccagtactcccagctactcgggaggctgaggcaggagaatcgcttgaacccaagaggtggagttgcagtgagccaggatctcaccattgcactccagcctggctgacagagcgagactctgtatcaaaaaaaaaaaaaaaaaattacacacttaataacagaccatcaaaatatatgaagcaaaaattaacagaattgaaggagaattagagttctacaataattggagacttcaatacccaatgctcaataatggacagaacaaccagatagaaaaaaaaggaaggaaatagagaactcaacacaataagccaactagatctaacagacatatatggaacacttcacccaataacagcagacagccgctgtggaaaacagcatggcagttcctcaaaaaattaagaatagaatggccagatgatccagcaattccactgccaggtgtacactcaaaaaaattgaaagcagagtctcaaggaggtatttgtacacccatggaggtaacccaaattttcatcaacacatgaatggagaggccaaatgtggtctacacatgcaatggaatattactcagccttgaaaaggaaggaaattctgactcacgctacaacatggatgaaccttgaggatattatgctgagtaaaataagccaatcacataaagagaaatactgaatgattccatttatatgacgcacttagaatattcccaatggccagtctggcgcagtggctcaagcctgtaatcccagcacttcgggaggcccaggtgagcggatcacctgaggtcaggagttttttgtttttgtttttgtttttgttttgagacaggctgtgtcatccaggcaggagtgcagtggcatgatcttggttcactgcagccttcacctcctgggctgaagcaattctcctgcctcagtagcccgagttgctggtattacgggggggcccaccaccatgctcggctaattttgttttgtttttttttttttttgagacagagtcttgctctgttgcccaggctggagtgcagtggcgtgatctcggctcattgcaacctccacctcctgggttccagtgattcttctgcttcagcctcctgagtagctaagactacaagcacacgccaccacccccggctactttttttggtgtttttagtagagacggggtttcagcatgttggccaggatggtctcaatctcctgaccctgtgattcgcccaccttggcctcccaaagtgctggcattacaggtgtgagccaccattcctggccaatttttgtatttttaatagagacaaggtttcaccatgttggccaggctggtctcgaactcctgacctcgtgatccttccgcctcggcttcccaaagtgctgagattacatgcgtgagccacctcacctggcaggttcaggacttcaagatcggcctggccaacatgccgaaaccacgtctctattgaaaatacaaaaattagctgggcatggtaggatatacctgtaattccagctacttgggaggctaaggcacgaagaatcgcttgaacctgggaggcagaggttgcagtgagccaaaatcgtgccactgcactccagcctgggtgacagagcaaggctccatctcaaaacaaacaaacaaacaaacaaacaaacaaacagagaatattcaaaatgttaaagacagaaagtagcatggtggttgccaggggctggcagaggagagaatggggaggagggaatgaagattttgcattaaacgggtacagagtttcagtcttacaagatgaaaagagccggccgggtgcagcggctcacatctgtaatcccagcactttgggggggccgaggcaggtggatcttttgaggtcaggagttcaagaccatcctggccaacaaggtgtaaccccgtctctactaaaaatacaaaaattagctgggtgtggtggtgcgcacctgtaataccagctactcgggaggctgagggaggagaattgcttgaacctgggaggcggaagttgtggtgagctgtgattgtgccactgcactccagcctgggcaacagagtgagactctgtctcaaaaaaaaaaaagaaaaagaaaaagaaaagagccatggagaaggatggtggtggtggttgcacaacattacaaatatgattaatatgtttaataccactaaactctgtacttaaaaatggtcaagatggtagattttatgttatgtataatttaacacaacatttttttctttttttttattattattatactttaagttttagggtacatgtgcacaacgtgcaggtttgttacatatgtatacatgtgccatgttcacaacatttttaaaattggaaaaaaagaaaaccagcagcaaggattttaccagagcaataagtagatgacagtcacatgaaaaagacattcgacatcattagccattagggaagtgaacattaaaatcacaatattactacagacctatcagaatgttaccacagacttatcaatgggtaaaataaaacttagtggcagtgccaaatgctggagaaactgggtcatttatacattgctggtgagaatataaaatagtacagctattctccaatttagtttagtagtttctttctttctttctttctttcttttttgagatagtttctcactctgtcacccaggctgcagtgcagtgggacgatctcagctcactgcaacctctgcctcccgggttcaagtgattctcctgcctcagcttcctaagtagctgggactacaggtgtgcaccaccatgtccagctaatttttgtatttttaggagagacggggtttcatcatgttggccaggatggtctcgatctcttgacctcatgatccacccgcctcagcctcccaaagtgctggatttttattatttttattattttattttatgttattttgagatggtgtttcattcttgttgcccaggcttgagtgcaatggtgcaatctcggctcactgcaacgtctgtctcccagtttcaagtgattctcctgcctcagcctcccaagtagctgggattacaggcatgcaccaccacacctggctaattttgtattcttttttagtagagatggggtttctccatgttggtcaggatggtctcgaactcccgaccttaggagatccccctgactcggcctcccaaagtgttgggattacaggcatgagacaccacgcctggactatttttttattttttgagatggagtctcactctgtcgcccaggctggaggatactggtgagatctcagctcactgcaatgtccacttcctgggttgcatctattctcctgcctcagcctcccaggtagctgggactacaggtgcgtgccaccatgcctggctaatttttgtaatttttttttttttttagtcgtgacagggtttctccatgttggtcaggctggtctcaatctcctgacctcaggtgatccacccgcctcagcctcccaaagtgctggtattacaggtataagccactgcactcagccatatataaccttcttcaaataaaattacacaggtggaaaatttttttctttctttttttttttttgagacagggtctcactctgtcgcccaggctagtgtgcggtgatgatgtaatcatggcttaagtgatcctccccgcctcaacctccctagtagctggaattacaggtgcacaccaccacatctgactaatttttttgtttttgtttttgtagacacggggtttcagcaagttgcccaggctggtttcgaactcctgacctcaagtcatccgtccacctcggcctcccacagtgctgggattactggtatgagctaccacaccttgcccgaaaacgttttcaaaataataaaatgggctgggcaagtggctcacgcctgcaattagaggcctggagacattaagtaaaccacccaaggtcacacagtaaggaaggggcagatctcagagtcgcctggctgcaaagctggtgtcccttccccactgtgccttaactgccgccttacagctgggttggaggatgcctccctggtctagggtcattattacattttcttttacaaagtatgtttctgataaacggaactgtttattttccaccgatggtcttatcctttgtccatctctttctgacggcaacagaaaacttcaccttccagaggagcgcctctgcctggctgtcccaccgtctgggaagtaaggagcgcctctgcccagcccccgcaccgtctgggaagtgaggagcgcctctggacggcccccgcaccgtctgggaagtgaggagcgcttctggacggctcccagcaaccccccaggtgtgaagtgacagccctgtgtgtgatctttctgccctccccaagtttgcattttcgacaataaaatttacttttaaattaaaagatttatactggggaagatttaaaaaaaaaaaaagaaagaaaagaaaactcaccttccaaaaacaaccactgggagtccgctttgtgcagaggttggacaagcttctgtgcaggtaggggcgctgctgctccccctaccacccacgcatcctcctccctgtctgcattcccgtcgtcgtagccagaggagttcagagcctctacagagagcacaacttctccagctggaacaaactccccttaaaggaatctatttaggaagattatttcaatgtacattcattcctccaaaatatgcttagatggacttaaataatcagaaagctgtgtgtgtatgtgtttcccgttttcttggcccacaaagaaccccttgagaggtccctgggcagtgagcctgtttatagacacccttctcccttccttggtgtcgcagacatcgcagtccctctgaggggctgacctgccccccaccttctggaagctgggaggttggaagaggggacgcatgccatggacccagcacacagctgggaactcgaggcacacctaagccttcccttgtgctgtgcggagtccacacttccttccccactggagtctcaaaacctcccctcactcaacagggtggtgctgctcaaagctctgggcacacattagggctggggagggggtggtggagagggggctccagcctgcccaaccaccaggcaacggggcacctgcccctctctcagctgggtctggacccgcctcccaggctcaggctgcaatgcctttctctttctctttgcaattccgttgggtcctgcccaggacagataaagacagagcagcctgtctttattggaggttcctctgccagcgggaagggtccggggaaaaccagagccagagccagagccagagaaacatgaagcaccccggggcctcccacaccaatgcctgagcaggaatggggaggggccatgactcataaggccctgggaggtcactttaaggagggctgtccaactgcaaggacgctgtaagcaggaagtgaaaccacagagcttcaaaaaaagagcgggacagggacaagcgtatctaagaggctgaacatgaatccacagatcaggtaccgctgcccactctgcctgctgggcccctcctgccccttcctgcctggtggtcctgctgggcctcaaccctggcctccccccgcccctgccccagccctgggctccctcccctctggctcccctgccacacgaatcccagtcaggctctttgtcctgctgtgtggtcaccccactgctgcttctgaatgggctgcctcccctacctgcaccagcccaggccccgtgctgagactctcccttaaagtcatgcccggactggtgctccccgccctgggagggtgctccctctgtgtgcttcctgccactcctgagctcagaaactgggagaattgaaccaaagggtaattggagcaatcaggcatttttgttctcagtgttttgatgaaatttctgtaagaattactttgcttaaatacaaagtcttaggagagggtgcgggggtaggaatggtctctgaagcacatgataaatcgtgtcatccaaggatgactccatggtgagcagatgtccccagacaggttccactccaaggtcactcttcatcttttagaacatgaccagtggttgagcgtggtggctcacacttgtaatcccaacactttgggaggccaaggcgggcggatcatgaggtcgggagtttgagaccaacctggcccatatggtgaaaccccgtctctactaaaaaacatacaaaaattagccaggcatggtggcgcatctctagtcccagatactcaggaggtttaggcaggagaattgcttgaacctgggaggtggaggttgcagtgagctgagatcatgccactgcactccagcctgggcgacagagtgagacttcatcaaaaaaaaaaagaaagaacatgatcagtaacatggaatgtgagaatgtgggaaaaaagtgcaatgatgaggagaaatgctctgattttaaaatttagtgaaaagagagcccagtccccaacagctttctcctacaggatccgtgatgcagaggctggacagggctggcctggaaaggggcccctgctccatccgtccccagctctgtggcctcggcaggttaccccgcctctctgtgcctctggcatctcctctgtaagatgggaatggcccctgcaggcctagggtagcctcacgtgagctcacacccgctcagcacttagaagagtggcctgggcctcagaattcagttctaccatgattttaaaataatgttaacacgcagagtgaaacatcaggaaggaattgagctgaaaggttaaaagctattttttaggggtgaagggttttattctcttttgcattctcctaatgggttggggagtgggttggcagaaatactaggagggtggggaatgtacccctggaaaggccagagttggacccgagctgggagagatcaccccagcccgcctgccagcatcccctcctcttcctctcccctcagtcttcctgcctgggaaggcagcagaaattctcagggctgtggaggggtcggggaggcccagggccatcctgggagctgtgttcagtggacatgagccccgaggactcccgggagggctccctgcatgggccggtttctctcttgtgccttcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtaccacccaaacttcaatcgaatcacaggcagtgttgcaggaattagaggactggagagactgatatgggtgagacaggaggatttatttaggtgcactggttcagcagactcacatccaaaaaggctgagcccttaacaaagacagactgaggtatttataagcaaacttacagaagcagaacaaaggcgattaatcaaacagtgacaggtcacataatctatagcataacagatgacttagcataacttggggccttctatagctggtggccttgcagctacatcaaaaggaaaacaggaactggctaaatacagacatttgtaaaatatagttataatggttctggaaaggagagacagtaaaggaatttgtcttttttttaaaaaatttttttaaaattttcttcaaccttgccctggaggggtgtgggggtggtgtctggagcccattcctttggccttgacttttcaggcagtgttataactgtcgttggagtgagctggctaggcagaggaaaacttgttcttcttttctttttaacccttgctacagtaggacctaagcagctggaaatgcagaaaacacaacaataagtaaaatgcccagcactgggctctcaattgtgtatttttcccacatttcttttttctctttttttccttttttttttttttttttttttccgagatggagtctcgctctggcacccaggttggagtgcaattgcacaatcttggctcactacaacctccacctctcaggttcaagtgattcttcggccttagcctcccgaatagctgggattacagaaggctgccaccacgcccagttaattttttctatttttagttgagactgggtttcaccatgttggccaggctggggaattcctgacctcaggtgagtcacctgccttggcctcccaaagtgctggggttacaagcatgagtcaccgcacctggccacttcccacagttctgtttttttgttttgttttgttttggtttttttttaagactgagtttcactctttgttgcctgggctggagtgcaatgactcactctcaacttccacctgccaggttcaagtgattctcctgcctcagcctgtgagctgaacagtcacatgagggtgaaggttgttgccacaagctcaggggatgctccagacagagtggcctgggatgtcgagtcacagctgctccatgccacggggacaagaggaagcaggagtttagtctgacacactgcccttccagatagagggcaagagacagaaagaggggctgaagtcacccttgaataaccacagcagtggcacccacaaaggtgcagtccccacagcctcatagcctcttctaggtgccacctcttaaggccattacaatagccattaacactgaacgtgagctttggagcagacaatcactcaaactaaacaggggggatggaggaaaggagcttcaatggcaagatcccctgggctcctgtcctggcccctcctctccctgccccacccctgcactcctcctgctccccctctcagagcatcccctgccccctgctcctctcccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaaggtgagaggtggaggggtcaggggagcgtgagcgggaggaacagcatgaaagatggatggatctgcaatgccatggctgggggtgtcccagggcagcctgcaggggtgggactggcactgactgcaactgacagccaggagaccaggcctgggaggacaggccagggtcaggggagagcctgactgcttcccgcttcttcatctcagaatttgcatactgctgggaaaactttgtgtacaatgaaggtcagcaattcatgccttggtacaaattcgatgaaaattatgcattcctgcaccgcacgctaaaggagattctcaggtgagggtctccctctggcctcatcatctctctcctctcacctgctcatcctcctgaggcctccgttggcctggccctcccgccctccctcttgacccactgcctgccctcatggtcacaccaccttcccttaactcctggtgctccctccacactgcctcctccctgctttcctgggcccttcctgtgagtaagaggccccttctgcctctaaggcacctgggtcttggactagaggaacaaacagcaagacagggtggcctgggacaccagccgctgcccttctgtgacatggggacaagaggaggcaagagctcagccttccagggaacaactctgggcaggagatgtggaaggaaggagctcagtgtgggggcacccatggcatcctggggggacatctgagggccacccccacccgctattcctccctccaatggtggcctctgagtgtgaaggcatgggggaaggcagacacctgcccctgactctccctcactaccacatagctgctgggtggctggggacggggggggtccctgggatgattcctgagggcaggatccaggggtccctccagatgtcctcccatccaggtgagaaagcagcataaagtgaggcttgcactcagatgggcctgggaggtcactcacagcgcaggtgtctcctggaacaagggccctggaagatagaaatagaatccaaacccaggactaacatcagggccaagacaagcctgccagggaggctgcacatgaagccccagatcagggaccactgcccgctctgcccatggggcctctgctgccctttcctgcctggtggtcctgctgggcctcagccctggcctccccctgtcccagccccagccctgggctctctcccctcctgttcctctgccacccccactcccagccaggctctttgccctgttgtgtggtcgccccactgctgcttctgaatgggccacctcccccacctgccccaggccagaccccctgctgagactcttccctgaaagtcaccgctgggctggtgctccctgccctgggagggtgctccctgtatatgcttcccaccattcctgagctctggaactgggagaattgaaccaaaggatgattggagcaatcaggcattttgttcttagcattttgatggaatttctgtaagatttactttgtttcaacacaaagtcttaggagagggtgtgggggaggaaatggtctctgtaccagaaaataagtcatttcttccaaagacgcctccgctgtgagcagaggaggatgcacacgaccccagacacaggctcctcctccgtgagcaccattcaccttttagaatgacacctgcaacatggagtgtaggaaaacatatgatcaggagaaatgctcttattttaggcagggcacggtggcttatgcctataatcctagctctttgggaggctgaggtgggtggatcacttgaggtcaggagttggagatctgcctggccagcgtggcaaaacctcctctctactgaaaatacaaaaaatgagccaggcatggtagcgggagccggtaatcccagctacttgggaggctgaagcaggagaatcgcttgaacccgggagggacagcagtgctggtcacggaaacacccaggactcaggactgaagcacaagtgtttccagtccccacacactaaaaaggagacaagaactcctcttcgagcttttctgatgagcactcacctctcaccctcaaacccctggggcctctcttttcctcctgaccctctctctggacctggcctcttgctctaggttcccagttttggtcccagtgctggtctctcctccaatggtaccaattccaggtctccttccacctcctggggcagatgcacagggagcctgaaaatcccagtggataatgatgctgtgccccagccagtgaagacagttggagaggggattctcttcacttgtctttaaatgagcatctactatttcttgcaaatgttccatgtctctggacttggcctaagccatttttatgttcagtgtcatctcgttctccctaatatttagaaaagggtgttgcttgtaggaccactttgctatgaagaagccttgtttccttttcttgagaacacaaagcaagtgagtggtagagcccagattcatacccaggtctactagaaattgtggcaaacagagattccttccttccttcctcccttccttccttccttccttccttgcttcctctctctttctctctttctctttctttctttctttctttctttctttctttctttctttctttctttctttctttctttcttcctttcttctctctcgtctttcttcttttgctgctgcctccaaacagagatttttctaattctggttttgtcaggatgtctacagaggggccgggagaggccttcaaggtggggctggtgtttccagcccaggagtcctgagctgccccatctggcctgagaagcacgtttgggagacctcatggcatccaaagggacgtggaaaatgctatgaattatccaaaaagatgtccctggcaggctcctctccccaatgatccccctcaggagtgtccctgccccaatgctgggtgtggtaggagttaaccctgcaggcaggaggaagccccagcaggtccatctccagcaggggctgtgggtgagcagagccaggacaggggtgcatggtgaggccagggaaggagacccagctctaccccagggagaggggcagggtcctccccggagggcctgagcacactgagctgaccctggggagaccctgacaaggcctaaacaggccccggggctgtgttgacttcctgataatccaccagaaggggtcagagagagaggatcagtggcccccacaaagggagtggaagcgcctcctctgacaggtgcctcagtatatggggagcagggaaggagtggggggtgcaggagaggagcgagaggtagtcccaggaggagtcttagggcttttggtttcccctgtctttgtccacagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggtgaccgacccagccacctgcatccaggcagggccctcccaatccagggacactcatagatagaaggttctgggtggtgcctgtggtttcctgcagtgtttgtcacttgtgcttcctgcagctgctgctgcttggccctggagttggggggagactttggcttcagtgactctccatggccaggtggggttgagtctgcccaatggcaaagtgcttcctgaggaccctcccaggatcccctcacagacacagctctcaccaggaatgattcggaactgtgggatttgaggactcagggcctacctgactcacaaggccaggatgtccctgtgccctctcttgggcttcatcctgcggagagacagactggggcaggagaggctgatcaggggttttgtcctgcccagggtggagcccacagcaaggccagaacaggtcccatgtcaggatgcaaagatggccagcagttggggaagaactgggccaggaaaggctgagggggccaggctaggctggccaggagccctgagcccaagggactttcttccctggcccctacccagcacagcctctgtctggagaggccaagttctgcttggctctgttgctggaaactgggggcttctctgggctctatgagctcaatgtgggcctcgctggatccacacacactgcttggaacatcctttcaagggtgccagtctccatcaccgcctaagcagtgggactcccccaggaatgacccacagccccttctcagcacaaaccatgtcatccacttcaccctgcatcccctctgatggaatccctccctgtctttgtccccatcacaatcacagtccttgctgccctgctgtccccaacttgaccgattcctagtcttagtggaaaatccttttctctgaagtttggagtaaataccatatttctataagtcaaaataatgacaattataccatgtcacagggaccttcccacattggagtgagtcctgctggtcttctcttccccactacttttggtggaattcattttggcctaagtctatatcacatttgggctcagcacaggttgtggcacagaatagaagtttctagaattatgggccacagatgggatgggagtaggggagttgatgagtagagcaggtcaatctccccttgaaggaagcacactcactcaggggcatcaggccaatgaccttggggctccgccggcccctcctccctgcccccatctctgtagcccctccctgcagggctgggtctggggtgagggtcctgaaggctctgaccttgggtacaaaattgatgggggctccaaatgctcagtaattagagaaaacacattttaatttaataattaatgcaatattttaaaacgcaaatttaatacaaatagatcatgatgaataaaagcaaagattttaataaagcctggcaggagagtgctgtcctgtgtatattggagctggggcaaaataaaacctcattgctcctgatctgtttgtatttaaatgggcaacattttgcttatcttgggatttttgcataacatctgatatttttaatattgcatagaaaatcatgcatcctaataaccggggttttggcgacccctctaatttcgtgctggaggcccccgcctccccagccccacctggtccaggcgctccctccctgttcaccacacatcacctcacactctgtttccttttctaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatggtaagaatggaaggttcaggtggggtggggtgggtgggggcaggagaggttcctgggaagaaaaggagaaaggccttggtctgctgcctgcagaaacgatggctggactctgggacctgactttggggtcgatgggaagagagaggccaggccaggagatatgggcccggggagggtggctggaagtggaagcagaacttggggatttccgaaagaaagagaactgggctggcccagattccaatgggaaggaagtacctgatgaaggagctaagtccctaggggagggagagggaaaggagggactgaaaccaggatgtgggaagtctgtcctgagagtcatgggcccttggtgctgccccctccccacaacaggagcgtgacttatctcccctgtcccttttcagagtttgagtactgctgggacacctttgtgtaccgccagggatgtcccttccagccctgggatggactagaggagcacagccaagccctgagtgggaggctgcgggccattctccaggtgagggcttcctccctctgcctggtgccccatcggcctccccctcctccccgctcccctgtgccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacactagcaaatgtgtagatgtctttccttgtgtagcggacctgtagctgggaaaggtcacacaacatccctctggatccagaaaactcagctaaaccacacaggagaggaacctaaatgcagaccccaccctcactcacagagccccgcccaccctcactcacagagccccgggcgctgattggaagggacaggcccagcagtaagaggacagtcagcagccagtctccctgttggaaaggaaccacaaacgtgcagtcaggggccctcgggagccgccctgtgtccaccccttcctgattccacccccctagagagggagcccaggggaggccatggctgagacccaggacagacccagtcgggggaaggagcccagggagggggcaggtgtctaggctgggcccagagagagggctggggagaggagcagcccaggaggcagagcccagccacagaggggaggggagctgagtcccggggacaggaagctccagaggcagagacggagcccagggctagggcggcaggtgtcagggctgtggcttcagcttggcgtctgtcctgggccttctgcgctggttcccaactctgggatgtgttatttatgtgcctgattacagtggcggctcccacctcacaatttctggaaagtcctcagaagccacgtataagaccaagaaggggcctcacatgcagctgctcctgggcagaaacgactcactgtttccctggcctagacacacacaacacactaacacacacaagacacacatacacacaacacacacaacacatacacacacaacacatgcacaaaacacatacacacacgcacccacacacagtgacagagacttcacaaaaagaaacctcctccaggttccccagagcacctgtccccggacggggactcccttgcatgagacagctggccaaggagaggactcccttctcccctgccagctttgtcaccttctacttgtttttttgtttttgttttgtttttgagatgaagttttgctcttgttgccaggctggagtgcaatggtgtgatatcggcacaccgcaacctccagctcccgggttcaagcgattctcctgcctcggcctctggagtagctgggattacaggcatgtgccaccatggccaactaattttgtatttttcatggagacagggtttctccatgttggtcaggctggtctcgaactcccgacctcaggtgatccgcctgcctcggcctcccaaagtgctgggattacaggcgtgagccaccaagcccagctcctctacttgttttctatgctgtctggctggtgtctcttctagtccaggtcacccagccctctctcgcctcagaccacggcacctgccattccctctctggacaaagcttccctcggctcttcccattgctatcccttctcttcctcaggattcagttcccaagtcacctcccctggcctcttgaagtgagctgcccacacagttcccttctgcctcatctccatgtctatttcctgcactgtccttgttacaaactggatttatcttccctgtgtgtagattctcatttcttgaccatctgcctccacttcccggaaacgcactgaggttggagtctaccgcttgctgcctgtgccttgactgcccagccttgccccctgggtaggaatccatttacaattgttgaaagaaaaaaaatgaatgattaaaaacagtatagacctagggcagtggctcacgcctgtaatcttagcactaggaggcaggggcaggtggatcatctgaggtcaggagtttgagaccagcctggccaacatggtgaaaccccgtctctactaaaaatacaaaaattagctgggcgtggtggtgcatgcctgtaatcccaggaggatgaggcaggcttgaacacaggaggtggaggttgcagtgagcctagatcatgccactgcactccagcctgggtgacagagcaagactcaactcaaaaaaaaaaaaaattaattaaattttaaatatagaatttttgtttttttgttttgttttgtttttgacatggaatctcactctattgcctaggctggagtgcagtggtgcaatcttggctcactgcaacctccaccttctgagttctagcaattctcctgcctcagctttctgagtagctgggattacaggcatgcgccaccctacccggctaatttttgtatttttaggagacacggggtttcactatgttggccagcctggtctcaaactcctgacctcaggtgatccacctgcttcagcctcccatagtgctgggattacaggcatgagccactgcgcccagcctatagaattttttttaattcttaagatttaaatacgacaatatgcgaacaccaaagtgtgtactccccaacttaagaaataggcacaacacaactcctagccacccccctccccattcatctgcaaagtgagtctagggaggttcttgtgattctttggcccaatttttttcctgtccaatacttttatagcagagatgatagaatgtaacagttaaaagcatgggctgtggatgcagaattcctggattcaactcccggctcttcctcctcctacctgtgtgaccccctattgagtgactcaccctctctgtgccttggcttggagctcattaaggcaggtaaagtattcaatggatggacccagccacagccatggccaacaggtaataaatagtgctatgctggaaactatcttgtgcccagaagttggagtcctgcgtctttccttatagtatagttacaaacatttccccacatcttaggaaaaggcttcaaaaggctgcataatatacgtgtgatagccaggtgtagtggcgcctgcctgtaatcccagctactcgggaggctgaggcaggagaatcacttgaacccgagaggcggaggttgcagtgagccgagactgcgccattgcactccagcctgggcaacaagagcgaaacttcatctcaaaaaaatccatgcctggaaagcccctgatctacaagttctcaccaacccccagtggagcacagttaggtagttttcaaatttccagtattgtccatgaagctgcgatgtggggtttcataattgcttaggcattttggacagatggtcgtagaacatttcctaagaactgaacaaagcttttgatgcacttagccaaacccgcctatgaaaatcttcttggagttcactgtccccacggaagggtgtgaggacctgcctcctcacccatctcgcagctcctctgcatctgggcatccccagtgaaactgtggcactagttggggaagaacagagccaacccaggggccagcaggagtccagccccaaaccaggacccggccactgttttggaaccaactccttcagtgttaccctacaacaccctcgccccatgaaggctccacctccagccctgggctcgccggagttacccagtcagacgatgccatttctgctccctcctgaaagaggaagtgtccaggatgagaacttcaggcaaagaggtgcctgtggatgggcagtgggagaagacttggagacagagcatctgtggctaaggacagggagatttggggtggtcatcacaaagaggagggcctgagggagggaaggcaccgttcctggggctgagaagtgaccccatccctgactctacacaaggaaaaatgagatgtggcctcgtggactaggctggattcggggcagaaggtcctggagaccaccagcaaagaaagcaaaaagctttccaggctcatcccaggtggtcggggcctcagagatgaacaagtgcctgccagggctgcagggcacccgtctgtgtcttcctttcatctcccctctgacctctggatgccagatgtctccaaaggacttcaacttttttttgtttgtttgtttttgttttttgagagagtctcactctgtcacccccgctggagtgcaatggcaccatctcagctcactgcaacctctgcctcccgagttcgagcgattctcctgcctcagcctcctgagtagctgggattacaggtacgaaccaccatgcccggctaatttttgtattttagtagatggggtttcaccgtgttggccaggcaggtctcgaactcctggcctcaggtgatctgcccgcctcagcctcccaaagtgctgggattacaagtgtgagccaccgcgcctgacctggacttcaactttaactatgaaaacctacagctggccaaagggcgaggggagacttgcctatcctaccatgtagagtgatcagatggtgacaccctgtcctgctggacaccagtgtccttcacaaccaggtgttagctggggatggacacaggaatcccagattggtagggaaaggggagccccccacaagaccagctttcttcctcccatcaggctcagaccaaacacattgcacaacgcagttgcatggaagccacaaagatggaaacccagggcctggggccctctgggagggacctacacacgatcatagcccccccgacaatgcctcgtgtgcccaacaccagcccaccaggtagctagagccattccctctggtcactggagcagagcagccaccacagcctcctgcaacacaccctcccatgctgcgcccacccgcctgggctctcccacctccctttgacctaccttgttcctgggcacagccccctgtcctggctgcagatctcagggtaacagacctccacacagctgctgatgcagaagtccaggctgcagtgcccacaagtggatagaggagggggtacgtgggatggaggggctcactatgggtcctcgttgatttccctacactgtgatctcctggagggaggaccatgtgccatccatccttgcatcccaggttcctgcctgagccgtggccctgagtgggtgctcttgggttactgttgaaggaatgaaggaactagtatatgaatgaaccagttgtccttccttgcctccccccttccctccctccctccctcccttccttccctcccttcattgacccttccttccctccctctctccctccctccttcccttccttcctttcttccttccttccctccctcccttcattgacccttccttccttccctccctcccttcattgactcttccttccttccctccctctctccctcccaccttccctccctccctccctccttccttccttccctccctatctccctccctccctcccttccttccttcacccttccctccttccctccctatcaggggacctggtccgataatcatgtaggttcttttctattttcttaagtgtcggctggcttgagaaataaagggacagagtacaaaagagagaaattttaaagctgggcttccgggggagacatcacatgttggtaggatccgtgatgcctcacaagccgcaaaaaccagcaagtttttattagggattttcaaaaggggagggagtgtgtgaataggtgtgggtcacagacatcaagtacttaacagggtaatagaatatcacaaggcaagtggaggcagggcgagatcacaggacctcaggactgaggcaaaattaaaattgctaatgaagtttcgggcaccattgtcattgataacatcttatcaggagacagggttttaagagcaacccgtctgaccaaaatttagtaggcgggaatttcctcttcctaataagcctgggagcgctatgggagactggagtctatctcacctctgtaatctcgaccataagagacaggtacgccctgggggggccagttcagagacctacccctaggtgcgcattctctttctcagggatgttccttgctgagaaaaagaattcagcgatatttctcccatttgcttttgaaagaagagaaatatggctctgttctgcccggctcaccggtggtcagagtttaaggttatctctcttattccctgaacaattgctgttatcctgttcttttttcagggtgcccacatttcatattgctcaaacacacatgctgtacaatttgtgcagttaatgcaattattacagggtcctgaggcgaaatacatcctcctcggctgacaggattaagagattaaagtaaagacaggcataggaaatcacaagggtattgattggggaagtgataagtgtccatgaaatctttacaatttatgtttagagattgcagtaaagacaggcataagaaattacaaaagtattaatttggggaactaataaatgtccataaaatcttcacaatccacgttcttctgtcatggcttcagctggtccctccatttggggtccctgacttcccacaacacctccctcccttccttgacccttccttccctccttccctccctccctcccttcctttcttcctcccttcttccctccctccctgcctccttccctccctccctccctccctccctccctccctctcaggagagagcagcacactggaatggctgagcttgaggaccccccatctggcttgcacagtcacccaaaccaccacccctccccttccctcctcttctgccttgaggaatctgactgtctggaaacttgtttctccttctccatgaacattctaaagccactggccatgcactggtgctaccaggtcacctggagcatctcctggagcccttgtccttaatgtgcccagacagtgaacagcttcctggctgagcatgtcaacgtcaacgagaaggcttgaagcctgacccctccactgccaacagccagaaattgcaggaaatgaggaccctgcaccgggctggtcagctgtcatgtgggatgtcagggggaggctttgggctgaagggtggttgggagccggtggggagagtccttggctaggactgtaggtgacaccaaggacaagactcaggacgtggaagactcaggacgtccacatggaaaggatgccagggccaaggccgagaggtgctggggagggctccccacctgccccacacaccatggcctcagcccctgtgacggaagctgactatctccccctcaccgcagtgtttagccctgctgggaagactgttcagaccaccagggaaagccctatgagacctggtcctgcctggagacggatggacgccaccagcctgtcctgggtcacagctgtccccagggctcttctctccctctgtaccttggcgggccccatcctctctccatttcctccatgatagccactttccagatttctaatgcaatacgttagtttagctttttctgcacttgctctaaacaccagcacatagtacacaatcttctgtgtgtggctcttgtcactcaaccctatgtttgcaaggttcacccattctgtttatcacggttgcaggtcaattcctattgctgtccactatcccacccgtgaatacccggcactcactttgccagttctgttgttgatgggcatttggctttgggtgtgatgactgtggcagagtggaggaagacacgaggggagcgagggggccgggggccgctgggacccggcttcaccaggaccatgttctctctgcagaacattgttcatttatctactcagtctctttgatcttttccaatctggtatgagaatgggctactgtatagtatttcaatggttactagggggagattaaactgatgtctttgttgttttaaactgttttgtttgtttgtttgttagtggtggttttctttttctttttttttttcttttctttctttttcttttttttttttgagatggagccttgctctgtcacccagggtcgagtgcagtggcgtgatctcggctcactgtaagctccacctcccaggttcaagcaattcccctgcctcagcctcccgagtagctgggactacaggcaaccaccactacgcctggctaatttttgtatttttagtagaggtggggtttcaccatgttggccaggctgctgtcgaactcccaacctcatgatctgcctgccttggcctccccaagtgttgggattacaggcatgagccaccacgcctggtctgttttaaactgttttttttttttttttttttttttttcccaagacaaagtcttgctgtgtcgcccaggctggagtgtagtggcacgatctcggcttactgcaagctccgcctccttggttcacaccattctcctgcctcagcctcccaagtagctgagactacaggcgcccgccaccacacctggctaattttttgtatttttagtagagacggggtttcactgtgttagccaggatgatctcgatctcctgatctcgtgatccacccgcctcggcctcccaaagtgctgggattacaggcatgagccaccgcgcccggccacaaagtgtttttaaggaaatttctatccactcttactccctttcatcccgtaacacgtagctctactagcctgctattgggctttcctgctaatgaacaaagttccatagcctcattctaaaaattgtgcacatctttgtatatacgaaatactataagataaagatgaagatgtcccctctcccctgcagcaactgaggggggagatcttgcttttatagaacgagttcaatgaatctgaacgtaagagtaaagtctggccgggcatggtggctcatgcctgtaaccccagcactttgggaggccgaggtgggcagatcacctgaggtcaggagttagcagagagcagagagcagcctggccaacgtggtgaaaccccgtctctactaaaaatacaaaaattagccagacgcggtggcgtgcgcctgtaatcccagctactcgggtggctgaggcatgagaattgcttgatcctggggggcggaggttgcagtgagccgagatcgtgccactgcactccagcctgggcaacagggcgaggctccgtctcaaaaaaaaaaaaagaaaagagtcaagtctgatattgacagagcatcagtcctgattttatgtgctattggatactggtaggaacgcttgtcactgttaccaagcagcacaaggggagcagtgtgagtggcaactctgcagccggctgcctgggtttcatcctgcttctgccacttactggattgtggcatttagcaagttacttagcacctctgtgcttcagtctgtcatatgaaatggagatgataatacaacttcttcattgtgggttgtgaggcttaaacgagtttgttcatattcatattatagctacatatattataaagagcacctggcccatagtgagccatttagaatattggtttgttatctatcaccagaaatctgtccctgaaaacagagtgttaaaaatcatcttgatggtcgggcacagtggctgatgcctgtaatcccgcactttgggagggcgaggcgggtggatcacctaaggtcaggagtttgagaccagccagaccaatatagtggaaccctgtctctactaaaaatatggaaattagccaggcgtggtggggtgtgcctgtagtcccagctacttgggaggctgaggcaggagagttgcttgaacccgggaggtggaggttgcagtgagctgagattgcgccactgcactccagcctgggcgacagtgagattccatctcaaaaaaaaaaaaaaaatcatcttgcaggcaaggtgcagtggctcacatatgtaatcccagcactttgggaggctgaggtaggtggatcgcttaagcctaagagttgaagaccagcctgggcaacatagtaaaaccctgtctctacaaaaaatacaaaaattatctggatgtggaggcgtgcacctgcagtcccaactacttgggaggctgagacaagaggatcacctgaacctggggaggtcaagattgcagtgagctgtgattgagccactgcactccagcctgtgtgacagggcaagactgtatctcaaaaaaaaaaaaaaaaaagaaaaagaaaaaaaatcatcttgcaaaagttgtataagacccatacacagaaaactacaaaactctactaagaactaagagaaagtttttaaaaacacctaaatcaatggtgagatataccatgttttgggattgaaagacttaatattaagaggttaaatcggccaggtgcggttgtgcatgcctgtaatctcagcactttgggaggctgaggtggacagatcacttgagatcaagagtttgagaccaacctggccaacatggtgaaacccggtctctactaaaaatacaaaaaattagccaggcgtggtagcgtgcacctgtaatcctagctactcaggaggctgaagcagtagaattgcttaaacctgaggttgcagtgagcagagatccagccactgcacttcagcctgggtgacagagcaagactccatctcaaaaaaaaaaaaaaaagtttacagatttgatgcaatcctaatcaaattctcagggtttggggtcagctcttctgcccccttgcggaagctctgtaatgtgtgcactaagtcaggatgccctcccttcccagcggtcagatttcagggctagccacagagaccgccctggcaagtctgctgggaggaagtgaggcagcagcccttttctggcatgctcacatctccttggcgtgaagcagcacctgggcctgcagctgccaggagcagtcctagatggtccctgagtgtctctgatcctgagccaagtgtgtgtctttagctccttgaggaaggtccccagtaggacacaattaaagtcagaggcaagaacgatgacatgggttctgtctctcctcgtacgctccacagctcagacctgtgggttccagctggctcttgctctcccacacctagcatccctcatccctttctgatggccccttgaaccaccccgccgcagacttcaagctccaacatcacaggcagtgaagacaacattttatgggggttgcttaaccagcccctgcaactggataaggtcagattcagattttttaaaattcgtaaacaaaatatatacatcttagtggttctgtttattggctgaaccccaactaatacacccctaaaaagcattaccgtggcagggtacagtggctcatgcctgtaattcaagcattttaagaggcaaagttggggccgggtgcagtggctcacgcctgtaatcccagcactttgggaggctgaggcaggcggatcacaaggtcaggagatcgagaccatcctggctaacacagtgaaaccccatctctactaaaaaaaaaaaaaaagaatacaaatttggccgggcgtggcggtgggcgcctgtagtcccagctacttgggaggctgaggcaggagaatggcgtgaacccgggaaggggagcttgcagtgagctgagattgtgccactgcactccagcctgggcaacagagcgagactccatctcaaaaaaaaaaaaaaagaggcaaagctgggaggattacttgagctggggagtttgaggttgcagtgagccatcactgcactccagcctgggcaacagaataagatcctgtctctaaaaaattaaaaaattaaatttaattaattaaaaatttaaaaattaaaaaaatgtttaaaaagcattattctctgctgggttcggtggctcacacctgtaatcccagcactctgggaggccaagatgggcatatcacttgaggtcaggagttggagaccagcctggccaacatggtgaatctccgtctctactaaaaatacaaagattagccgggcgtggtggcagctgcctctaatcccagctactcgggaggctgagacaggagaatcgcttgagcccaggagtgggaggttgcagtgagccgagatcgtgccattgcactccagcctgggtgacaacaatgaaactctgtctcaaaaaaaaaaaaaaagaaaaaagcattattctcctacatctctccaaaattacttaaaatattttaagggacaaatggatatcgatttccaatgagttcagggtaggctgtgctgctagacacggtggtgtccgtatttgagctcgattcccgttcttgctagggtagcacgttatcgctcctaaatcattcacgcgttaaagacaaaatcatagtgtgaattaggcacacttagaactcaatgatctttttttcttttttttgaggcggagtctcgctctgttgcccaggctgaagtgcagtggcacgatctcggctcactgcaacctccgcctcctggattcaagcaattctcctgcctcagcctccagagtagtgctctagcaaattaactgaacccaaagaatgggtcatgggaacctcaacttgaagcctgttggtcagacactccagatgtctgagctttctactggtgtctaaagcaggggcagttttggggactgggccctcaacctgtgagatctgacaccatctcaaggcaatgttggatgtgactgagaggacacctggctggtgcctgctgaagaatggattgcttgtttgttggtgggaagaaatcccccacatttggtcacagaagtcttctgtgttgactgttgttgtgttggtgcgagagcagaggaaaaacacggcttgagtttgtgtgtttttctacacactcagtttcccaagccctcttaattcccagccgttgcttgttgcctgttgctggggtctcccggccaaagctgaatgcctcttcacaagaccttgtcgtgagtctttctgtggtgtatctgtctgaccctcacccatctgaagctttctgtaggatgttaggtacataatctctctttgaccatggttttaactcccggccaccaattccagggcagatggaaaagtcgtgcttggccttctagcacacttacataaatattccataaaagtaagaatcaccaaaactgacacaaaatggagaaaaatcactcagttaggtcgatcatcaatgaggacactgaaaaggtaaccaatcctcacctaacctcaggccttgatggttttactggcaatttctaccaaattgtcaatgaacagatcattccacattacagagactattccagagaaaagaaaatgatgggaagcttcccaaatcatgaccgaggtttatcacaaccctgatgctacaactgggcaaaaatagaaaacaattttttaaaaactataattcatgagtaatttcagtcaatgagacacagcagcccaggaactgaagagtccctgactaaaaaggcattaaatctggccgggtgcggtggctcatgcctgtaatcccagcactttgggaggctgaggcaggcatatcacctgaggtcaggagttcaagaccagcctggccaacatggtgaaacactcctctctactaaagatacaaaaattggccgagcgcggtgtctcatgcctgtaatcccagcactttgggaggccgaggtcggcagatcacctgaagtcaggagttcgagaccagcctggccaacatggtgaaacctcatgtcaactaaagatacaaaaaattagctgggtgtggtggcatgtgcctgtaatcccagctactagggaggctggggcaggagaatctgttaaacctgggaggtggaggttgcagtgagccgagatcacaccattgcactccagcctgggtgacagggcgagactccatctcaaaaaacaaaaacaaaaacaaaaaacaaaaattagccaggtgtgttggcacgcacctgtaatcccagctactcaggaggttgaggcaggagaatcacttgaacccaggaggcagaggttgcagtgagctgagatcgtgccactgaactgcagcctgggtgatggagcgagactcagtctcaagaaaaaaaaaaaaaacagaaaggtatttaatctgcaggccccagagctgatggcttcccggagctgggcaggtccacactccctcagcctcaggaccaagtgtccgtgtgcgtgagtgacaaggggcctcagaagctacacgtgggagtcctgagacttccgctctgtgctgttacacacgttgtcccacctgtcctgtatcttttcttaaagccaaggaaatgcatactgggtgaagcctatcacgtctcttttgatagtcaatccaaatcacaagccactactacttgtcaaacagaatgatattgcaactatatcaatagattaaaggagaaaaaccacatgaccatctcaatcataaaaaacagaaagcatatgctattaaaatagcatcttaggaccaggcactaatcccagcattttgcctgtaatcccagcattttgggaggctaaggcaggtggattacttgaggtcaggagttaatgaccagcctggccaacatggtgaaactccatctctactaaaaatataaaaattggccaggtgtgaaggtgaacacctgtaatcccagctactcaggaggctgaggcaggagaatcgctagaatccgggaggcagaggttgcactgagccgagatcgtgccaatgcactccagcctaggcaacagagcaagactccatctctaagataaataaaataaataaaataaaataaaataaaataaaatataaaataaaataaaaaataaaataagtgaaatgaaatgaaataaaacaaaatagcgccttagaagatgcaaaggtagcttagaagctatcttaagagcttgaagcatgctgccatgccaaagaaagcattcccagttcaacaaaagtcttagcaagctttcttcatctcataaaaggtttctagataaaaggttagtctactacaagtatctactagatggtgaaatcaaagtcaagagaaaaggctggctcctgaaaccccaatccagcattgggctagaggtttctgccaacagaaaaatgggcaaatgatatgcacaggcaatttatagaagaaatgaaataagcaataaaatatgcaaaattgaacagccttattaatatacaagtaaacactagtgggaatatcaactgggaatctcactttggagagtgtggcagacactaaaggcaggctcacccaaatgaataaaaataaaatgtaatgcaaatagtaaccaaaagagagcagcagtggctacactaatatcagataagagattttttttaaccaggtgtagtggctcacgcctgtaatcccagcactttgggaggccgaggtgagccgatgacctgaggtcaggagttcaagaccagcctgaccaacatggtgaaaccccgtctctactaaaaatacaaaattagctgggcgttgtggcgcatgcctgtaattccagctacttggaaggctgaggcaggagaatcgcttgaaccgaggaggtggaggttgcagtgagccaggatctcaccattgcactccagcctggccaacagagcgagactctgtatcaaaaaaaaaaaaaatttacacacttaataacagaccatcaaaatgtatgaagcaaaaatgaacagaattgagggagaattagagttctacaataattggagacttcaatacccaatgctcaataatggacagaacaaccagatagaaaaaaaaggaaggaaatagagaactcaacacaataagccaactaggtctaacagacatatacggaacacttcacctaataacagcagacagctgctgtggaaaacagcatggcagttcctcaaaaaattaaaaatagaatggccagatgatccagcaattccactgccgggtgtacactcaaaaaaattgaaagcagagtctcaaggaggtatttgtacacccatggaagcaacccaagttttcattaacacatgaatggagaggccagatgtggtctacacatacaatggaatattactcagccttgaaaaggaaggaaattctgacccacgctacaacatggatgaaccttgaggatattttgctgagtaaaataagccaatcacataaagagaaatactgaatgattccatttatatgacgcacttagaatattcccaatggccagcccggcgcagtggctcacgcctgtaatcccagcagtttgggaggcccaggtgagcggatcacctgaggtcaggagttttttttttttgagacaagctgtgtcacccaggcaggagtgcagtggtgtgatctcagttcactgcaccctctgcctccccggctgaaggaattctcctgcctcagtctccctagttgctgggattataggggcctgccaccatgcctggtgttttgttgttgttgttgaccgagtcttgctctgttgcccaggctggagtgcagtggtgtgatctcggcttattgcaacctctgcctcctgggttccagtgattcttctgcctcagcctcctgagtagctgagactacaagcgcacaccaccacccccagctattttgtgtgtgtgtttttagtagagatggggtttcaccatgttggccaggatggtctcgatctcctgaccttgtgattcgcccacctcggcctcccaaagagctgggattacaggcgtgaactaccatgcccggccaagtagtttcttataaaactaaacgtgtacttaatatacaatccagcaattgcactattgggcatttattccagagaaatgaaaacttatgctcacatttaaaaaacaaaaacaaaaacaaaaacaaaaacctgtgttcatagcatctttgttcacgatagccaaaaaccacaaccagtctaaacgtccagtgggcgaatggttcaacctgctttggtacatccatgcaatgagtcgtgccctgcaatgaaaacgaacaacctatggaaaccagcaacaattcagatgaacctcaagggtattatgctgagtgaaaaacgtcagtgacgaatgattccgtatatacattccacatataatcatatactgatgattctatatatatcaaaagaaatcatattaaaagatcccatatatatattctagatatatatttcatataatcatatactaaagatcccatatatataaaaccttctttttaatatttatttttattattttattttgttattttgagatgatgtttcattcttgttgcccaggcttgagtgcaatggcgcgatcttggctcaccacaacctctgtctcccgggttcaagtgattctcctgcctcggcctcccgagtagctgggattacatggtggcatgcaccaccacacctggctaattttgtattcttttttagtagagacggggtttctccatgttggtcaggatggtctctaactcctgaccttaggagatccccttgcctcagcctcccaaagtgctgggattacaggcgtgagccaccacacatggcttattttttaaattttttcagatggagtctcactctgtggcccaggctggagtacagtggtgagatctccgctcactgcaacgtccacttcccaggttccagctattctcctgcttcagccttccaggtaggtgggactacaggtgcatgccaccatgcctggctaattttgtaattttttttttttttagtcatgacggggtttcaccatgttggtcaggctggtcttgatctcctgacctcaggtgatctgcccgcctcagcctcccaaagtgctggtattataggtatgagccacggcaatcagccatatatataccttttgcaaataaaattacacaggtggaaaacgtttttctttttcttttttttttgagacagggtctcactctgtcgcccaggctggtgtgcggtgatgcaatcatggctcaagtgatcctcccccatcaacctccctagtagctggaattacaggtgcacaccacatctggctaattttgtttttgtttttgtttttgtagacacggggtttcaccatgttgcccaggctgatctcgaactcctgacctcaagtcatccgtccgcctcggcctcccacagtgctgggattactggtgtgaaccaccacacccggcccgaaaaggttttcaaaataataaaatgggctgggcaagtggctcatgcctgcaattagaggcctggagacattaagtaaaccacccaaggtcacacagtaaggaaggggcagaactcagagtctcctggctgcaaagctggtgtcccttccccactgtgccttaactgccgccttacagctgggttggaggatgcctccctggtctagggtcattattacattttcttctaagaagtgtgtttctgatcaacggaactgattattttccatctatggtcttaccctttgcccccatctctttcttatggcaacagaaaatttcaccttcaagaggagcgcctcggcccggccgaagtaccgtctgggaagtgaggagcgcctcggcccggccgaagtaccgtctgggaagtgaggagcacctctggacggccacggagcaaccctccaggtgtgaagtggcagccctgtgtgtgatctttctgccctccccgagttttcattttcgatagtaaaatttacttgtaaactaaaagatttatattggggaagatgaaaggaaggaaggaaggaaacttcactttccaaaaacaaccactgggagtccgctttgtgcagcgataggtaagcttctgtgcaggaacgggcgctgctgcaccccctaccacccacgcagcctcctccctatctgccttcaggtggtagccagaggagttcagagcctctacagagagcacaacttctccagctggaactgaagggggcctgcccctccacaccggcgggtatttctcgaaaggtggagatgagagactgagaaaagaaataagacacagagacaaagtatacaggaagaaaagtgggcccaggggaccggcgctcagcatatggaggacccgcatgggcactggtctctgagttccctcagtatttattgatcactatctctaccatctcagcgagggggatgtggcaggactatagggtaatggtgaggagagggtcagcaggaaaacatgagagcaaaggactttgtgtcataaataagtttaaggaaaggtgccgtgcctggatgtgcacgtaggccagatttatgtttgactttatacaaacatctcagtgcagtaaagagcagtattgccgccagcatgtctcacctccagccataaggcggtcttctcctatgtcagtaaatagaatgtatgatcgggttatacaccaagacattccattcccagggatgagcaggagacagatgccttcctcctatctcaactgcaaagaggctttcctccttcaccaatcctcctcagcacagaccctttacgggtgtcgggctgggggacggtcaggtctttcccttcccatgaggccatatctcaggctgtctcagtggggggaaacctggacaatacccaggctttcttgggcagaggtccctgcggccttccgcagtgcactgtgtctctgggtactcgagactggagaatggcgatgacttttaccaagcttattgcctgcaaacacatttttaccaaggcacatcctgcacagccctaaatccattaaaccttgagtcaatatagcacatgtttctgcgagcacagggttggggctagggttacagattcacagcatctcaaggcagaagagtttttcttagtacagatcacaatggagtttcttatgtcttcctctttctacatagacacaataacagtctcatctctctttctttcccccacaagaacaaactccccttaaaggaatctatttaggaagattatttcaaggatacaatgtacattcattcctccaaaatatgcttagatgaacttaaataatcagaaagttgtgtgtgtatgtgtttcacattttcttggtccacacggaaccccttgagaggtccctgtgggccgtgagcctgtttgtagacacttgcttccaccgcttgatgtcgcagacatcgcagtccctgatgtagggtctggccctatggggcttagtgggtgttctccccgtgtgtggagatgagaaatcgtaaaaagtaaagacacaagacaaagagataaagcgaaaacagctgggcccgggggaccactaccatcaagacacggagatgggtagtggccccaaatggttgcgtgcactgttatttattgcatacaagacaaggggggcagggtaaggagggtgagtcgtccaagtgattgataaggtcgagcaagtcacgtgatcataggacagggggcccttcccttataggtagccgaagcagagagggaaggcagtatacgtcagcgttttcttctatgcacctatcagaaagatcaaagactttaagactttcactatttcttctaccgctatcttctgagaacttcaaagagggaccaggagtacaggaggaaagtggacaaggagcgtgaccattgaagcacagcatcacagggaggggtttaggcctccggatggctgcaggcaggcctggatactatccagcctcccacaagaagctggtggagctgagcgttccctgactcctccaagaaaagggagactccctttcgtggtccgctaagtaacgatgccttcctaggcactggcgttaccgcctgaccaaggagccctccagtagcccttatgcgggtgtgacagagggctcacctcttgcattctcggtcacttctcacaacagcccttcagcacctgaccctatacccaccggttatttcttggttatattagtaatacaataaagagtaatattaaaagctaatgattaataatatctacactaatgattgataatgtccatgatcatctctgtatctaatttgtattataactattcttattgtaagtatattctttattatactgaaacagtttgtgccttcagtctcttgcctcagcacctaggtaatcctccgcccacatctctgaggggctgaactgccccccaccttctggaagctgggaggttggaagaggggatgcgtgcgatggactcagcacacagctgggaactcgaggcacacctaagccttcgcttgtgctgtgcggagtccacacttccttccccactggggtctcaaaacctcccctcactcaacagggtggtgctgctcaaagctctgggcacacattagggctggggagggggtggtggagagggggctccagcctgcccaaccaccaggcaacggggcacctgcccctctctcagctgggtctggacccgcgtcccaggctcaggctgcaatgcctttctctttctctttctcttctttttgcagttccgttgggtcctgcccaggacagataaagacagagcagcctgtctttatcggaggttcctctgccagtaggaggggcccggagaaaaccagaaagagggccagagccagagaaacatgaagcaccccggggcctcccacaccagtgcctgagcaggaatggggaggggccatgattcacaaggccctgggaggtcactttaaagagggctgctcaactgcaaggacgctgtaagcaggaagagaagccacagcgcttcagaaaagagtgggacagggacaagcatatctaagaggctgaacatgaatccacagatcaggtacctctgcacgctttgtccgccaggcccctcctgccacttcctgccaggcggtcctgctgggcctcagccctggcctccccctgccccagccccacctctgggctccctcccccctggttcccccgctgcccccactcccagccaagctccttgccctgctgtgtggtcccacgactgctgcttctgaatgggccaccttccccacttgccccagcccagtccgcctgctgagactctcccccgaaaatcatgcccgggctggtgcttcccgccctgggagggtgcttcctctgtgtgcttcccactattcctgggagctctggaactgggagaattgaaccaaaggatgatttgagcaatcaggcattttgttctcagcgctttggtgcaatttctgtaagatttactttgtttcaatacaaagtcttaggagagggtgtgggggagggaatggtctctgtaccagaaaataagtcacttcttccaaagatgcctccactgtgagcagagtaggatgcacacgaccccagacacaggctcctcctctgtgagcaccgttcacctttcagaatgacacctgcaacatggagtgtaggaaaaaatatgatgatcaggagaaatgctcttattttaggccaggcacggtggcttatgcctgtaatcctagcactttgggaggctgaggcgggcgggtcacttgtggtcaggagtttgagaccagcctgactaacatggtgaaacctcgtctctactgaaaatacagaaaattagccaggggtgctggcgggcgtctgtaatcccagctacttgggaggctgaggcaggagaatcccttgaacccgaggggtggaggttgcagtgagctgagattgcaaactccagcctgggggacagagcgagatgccgtctttaaaaaaaaaaaaaaaaaagtagcagaaaaactgggaggttgagggtgttccattggtagccccagagctggggttccagctaggagaggtcaccccggccctgctgcccctgccagcgtcccctcctctttctctctccccgtcttcctgcctgggaaagcagcagacattctcagggctgtggagggatgggggaggcccagagcccagggacgtccaggcagctgtgttcagtgggcatcagccctgaggactccggtgcgggggtctctgcattggggtttctctcttgtgccttcagaaacccgatgaaggcaatgtatccaggcacattctacttccaatttaaaaacctatgggaagccaacgatcggaacgaaacttggctgtgcttcaccgtggaaggtataaagcgccgctcagttgtctcctggaagacgggcgtcttccgaaaccaggtagcaccaaagtcctagttacaccctaaataggagctaagcagctgggaatgcagaaaacgcaacaataagtgatgtgcccggcgtgggctctcctgtgtgcactttcctgccacatttctatttttttttttttttttttgagatggagtctcgctctgtcacccaggctggaatgcagtggtctgatttcagctcacggcaacctctgctttccaggttcacgcgattctcctgcctcagtctcccgagtagctgggattacaggcacctgccaccatgcccagccaattcttttgtatttttagtagaaacaggattttgccatgttggccaggctggtttcgaactcctgacctcaagtgatccaccagccttggcctcccaaagtgctaggattacatgcgtgagacaccatgcccctggcctcctccccacattatttatttatttatttatttattttgagacggagtcttgctctatcgcccaggctggagtgcagtggcacaatctcagctcactgcaagctccgcctcccgggttcacgccattctcctgcctcagcctcccaagtagctgggactacaggcgcccaccaccatgcccagctaattttttctttttttctttttttttttttttttagtagagacggggtttcatggtgttagccaagatggtctcgatctcctgacctcatgatccgcccgccttggcctcccaaagtgctgggattacaggcatgagccactgtgcccggcctccccacattttttaagtccatggcccagatcttcctccctgactctcctgtgatcagatcgtggagggggtttgcttcctcccaaaaggccttgtttagcgcccagcaccctcactcttgactttgtttcccaaaatcttgttatggagctgtgcgtccggcagtcctcgggaatcagcagctgtgggaagcggggggtgttgtgtccagcgctgtgtctgggccagtgactgcgggctggtggggccgcccccgccactgccctgattcctcagcagaaggcaggcagggaacaaagctgaccccagagagccaggccatagcaggggctgaggatgcctggtgaatggatgcctgggagaaaagatggcagaattcacacatgagtctatgagacagggaaagaatcaataaaataaagaaggaaggggccgggcacggcgcggtggctcatgcctgtaatcccagcactttgggaggctgaggcaggcggatcatgaggttgggagttcgagaccagcctggctaacatgatgaaacccagtctctactaaaaatacaaagattagccaggtgtgggggtgcatgcctgtagtcccagctactcaggaggctgaggcaggagaattgcttgaacctgggaggcagaggttgcagtgagccgagattgtgccactgcactccagccttggcgacagagcaagactccatctttgaaaaaaataaaaataaaagaataaagagagaaggagaaggatagaagaagggaaactcaatgaataaaacaccctggggcctactatgtagccagaaaaatgaaaagtaaagaaataaaataaggctgtgcatgtggtttatgctcatagtcccagagctttgggagggtgaggcaggaggatcgcttgagcccaagagttcaagatcagcctgggcaacatggtgaaaccccgtctctaaaaaaattatttaaaaaattaggcaggtgtggcggcatgcacctgcatcccagcttatcaggaggctgaggtgggaagattccttgagcctgggaggtcaaggctgcagtcagcccagatcccaccactgcaccccctaacctgtgcaccagagagagaccctgtctcaaaaatgagtaaataaggaaacggcccggggctccaggcccgccctctgctcccatcgccccacccctgcactcctcctgctcctggtctgagctcccctgtcctcctcctcctccttcgccaggtggattctgagacccattgtcatgcagaaaggtgcttcctctcttggttctgcgacgacatactgtctcctaacacaaagtaccaggtcacctggtacacatcttggagcccttgcccagactgtgcaggggaggtggccgagttcctggccaggcacagcaacgtgaatctcaccatcttcaccgcccgcctctactacttccagtatccatgttaccaggaggggctccgcagcctgagtcaggaaggggtcgctgtggagatcatggactatgaaggtgagacgtggggggctgaggagagtgggtgcaggagggacagcatgaggggcagatggttctccaatgctgtggggcgggtcagtgtcccctgggtgtctgtggggaccgggccagcgcccactgcaactggcagcctggatacctgggctgggaggggagggcccagggccaggagagaggcctgctgggccctcactgttttctccttgttttttctcagattttaaatattgttgggaaaactttgtgtacaatgataatgagccattcaagccttggaagggattaaaaaccaactttcgacttctgaaaagaaggctacgggagagtctccagtgaggggtctccctgggcctcatggtctgtctcctctagcctcctgctcatgctgcacgggcctcccctccaccctggacccgctctgtttctgcctggtcatcctgagcccctcctggcctcagggccattccacagtgctcccctgcctcaccgcttcctcctcgctcttccagactcttcctgcagaggctcctttctgcctccatggctatccatccacccccacagaccccgttcctccagcctgcgtgcccctaacctggcttttcccatctccccagcataaccaaatcttactaaactcatcctaggctgggcatggtgactcacgcctgtaatcccccagcaatttgggaggcaaaggtgggagaatcgcgtgagcccaggagttccagaccaggctgggtcacatgacaaagccccatctctacaaaaaaaaaaaaaaaaaaaaaaaaaaagccagatgtggtggcatgcatctgtagtccaagctacttgggaggctgaagtgggaggattacttgagcccgagaggtggaggctggagtgaacagagatcgcgccactgaactcgggtctgggcaacagatagagaccctgcctgaaaataaatcgataaataaactcaacctaaacaggtgtgaatatatgtaagttgaaaacccgaagttttgagaaacatcctttgtaaatttcatcctatgaattgggtcattcatgtcctacccagctaaaacagaggccaggagccagggaggaaaagcagtcaggccacacaacattgtttccgaaatggacttctctgcaagcctgactcctgagactgtgcattgtaccctgaaaccagctttatccatagcttctgcgataaatggctgtaagtcttggactccttgctccaaacgcagcgactcagcaatagaacctcccagctcccagcccttcctagtgcccatgggctttacatagggcaagagaacatttctccttctataattgccatctctttgctctctcaacatggtgaacaccatccggactccgtgtatgtctcaaattacaattctttctttgcaaatgaaatatgaaatttagaggctcttctaaacactttaaatttgatttgacattttcaaagcagatgtaagttttagagaatgagattctccataaaaatgaccctttcatgctgtggcctccatagaagatgtcccaggccaggtgcccacatggcaggcatttattttctcacagatctggaagctgcaggtccaacttcgaggggtgggtggggttgtttcctctgaggccgctccttctggctggcagggagtctcttccagccgtgtcctctgtggcctttcctctatgcacacgcacctctgggatctctctgcctccaaatatcatcttttttttttttttttttttttttgagacagagtgttgctcctcttgtccaggctggaatgcaatggcacaatctggactcactgcaacctccgcctcccgagtttaagcgattcttctgcttcagcctcccgagtaaaaggcatgcatcaccacacctggttaattttgtagttttagtagagatggggtctcaccatgttggccagactggtctcgaactcctgacctcaggtgatccgcctgtctcagcctctccaagtgctgggattacaggcatcagccactatgcccggctgggatcatatgttccacacatgtttgttcaataagcatggactgcaaccacctacatgaatattcatagctcctcctgtagcctgttgaatatgtatgtttagccaacctcttcagcataaagctcctgcccaaacccctcctgctcctaaatgtctgtctctggtgttaaccagaggctgctcttcccaggctgctggatggctaccttgcaggctgtcacccttaacaagaaataaagtgtcctttgcaaatgcatcccttgtgtaatttgtaggtcaccgcgccatgggaacacgctaccatgggaagggagctgtgagacgcgcagggaggctccagacaggctggcctgggacaccagccgctgcccttccataacatggggacaagagagggcaaaagttcagcccaacacggaggatcttcgggcaggagatggggaagaaggagaagcaggaaggaaagagctcagtgtgggggcgcgcatggcatcccggtgggacatctgaggcccacacccacctgctgtccctccctcccacggtggccaccgagggtgaaggcctggggggaggcagacgcctggccctttactctccctccctgtccccatggccgctgggtgggggccgtctctgggatgatccccgagggcaggatccgggagtccctgcagaggcatcagcctgtctgtcttgatggtggagtggcggctccagctgggcgggaccaccaggggaggggcttgtgctctgctggctcagcctggtgtggacccacctcccgggcgctggctgcaatgactttctctttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagggggaggggccatgactacgaggccctgggaggtcactttttttttttttttttttgagaggaagcctcgctctctcacccaggctggagtgcagtggcaggaacttggctcactgcaacctccgcttcccaggttcaagtgattctcctgcctcagcctccagagtagctgggattacaggcgcacgtcaccacacctggctaatttttgtatttttagtagagacggggtttctccatgttggtcaggctggtctcgaactcctgacctcgtgatccgcccgcctcggcctcccaaagtgctgggattacaggcgtgagccaccgtgcccggccgggaggtcactttaaggagggctgtccaactgcaaggagccgcaagcaggaagtgaaaccacagcacttcaaaaaaagagggagactgggacaagcgtatctaagaggctgaacatgaatccacagatcaggtaccgctgcccactatgtccgcagggcccctccggccccttccttctggtggtcctgctgggcctcagccctggcctccccctgccccagccccagccctggacttccttccctctggcttccctgccgcccccactcccagccagactccttgccctgctgtgtggtcgccccactgctgcttctgaatgggccaccttccccacctgccacagtccaggccccctcctgagactcttccctgaaagtcatggccaggccggtgctccctgccctgagagggtgctccctctgtgtgcttcccaccattcctgagctcaggaactgggagaattgaaccaaaggatgactggggcaatcaggcattttgttctcagtgctttgatgaactttctgtaagatttactttgtttaaatacaaagtcttaggagagggtgtggggagggaatggtctctgaagcacaagataaatcacatcgtccaaggatgactccacagtcagcagatgtccccagacaggttccactccaaggtcactcttcatcttttagaacatgaccagtaacatggaatgtgagaaagaacgcgatgatcaggagaaatgctcttattttaaatttagtgaaaagagagcccagtccccaacagctttctcctgcagggcccgtgatgcagaggctgcacagggctggcctggaaaggggcccctgctccaactgtccccagctctgtggcctgggcaggttaccccacctctctgtgcctctgacccctcctctgtaagatgggaatggtccctgcaggcctagggcagcctcacatgagcccacccccacgcagcacttagaagagaggcctgggcctcagaattcggttctaccatgattttaaaataatgttaacacgcagagtgaaacatcaggaaggaattgagctgaaaggttaaaagctatcttttaagggtgaagagttttattctcttttgcattttcctaatgggttggggagtgggtgggcagaaatactgagagggtggggaatatacccctggaaaggccagagttgggcccgagctgggagagatcaccccagcccccctgccagcatcccctcctcttcctctcccctcagtcttcctgcctgggaaggcagcagaaattctcagggctgtggaggggtgggggaggcccagggccgtcccgggagctgtgttcagtggacatgagccccgaggactccaggagggctccctgcatgggccggtttctctcttgtgccttcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggcccggtactacccaaacgtcagtcgaatcacaggcaggaggtaagcagctgggaatgcagaaaacacataagtaaaatgtctggcggcgggctctcaactgtgtattttttccccacatttatttattttttctatttatttatttatttatttattttgagacagagtctccatctgtcgcccaggctggagtgcagtggtgcgatctcagatcactgcaacctccacctcttgggttcaagcgattctcctgcctcagcatcctgagtagctgggactacaggcgcgtgctaccacgcccggctaatttttgtattttcagtagagatggggtttcactgtgttgagcaggctggtctggaactcctgatctcaggtgattcacctgccttggcctctgaaagttctgggattacaggcataagccaccgtgcctggccacttcctatatttcttttttcttttctttctttctttttttttttttttgagacagagttttactcttgttgcccaggctagagtgcaatggctcaatcttggctcattcaacttccgcctcctgggttcaagcgattatcctgcctcagccacctgaatagcagggattacaggtgcacgccaccgtgcccagctaatttttttgtatttttaatagagaagggatttcaccatgttgtccaggctggtcttgacctcctgacctcaggtgatccacccaactcggcctctgaaagtgctgggaatacaggtgtgagccactgcgcctggcctccacttcccacatttcttaagtccgtggcccagaccttcctgcttgaccgccccggccaccgcccggattcctccttggcaaagatgcctcatcacagtttggtgaaccctcactcctcaccctgccacccccactggggacactaagttccccgccttgtcccacccatccctacggccccctccacccagggaggagacttttcagagtgtgtttggggagggagtcgtctgtatgctgggcagtcctggcctacagcggtgctggccacggaaacacccaggactcaggaatgaagcacaagtgtttccagtccccacacgctaaaaaggcgacaagaaccggtgaaagtaattttaatattctatttaatccagtgtagctaacatattacttcaacgctgattaacataaaattcttcgcgagatagtgaagtttctttttcttctcacactgaaatgagtggtgtatttttgatgtgccgaggtctctcatcagagccctgtttcagatgctcagtagcgcccttggccagtgccccccaatatgggacagcgcaggtccagtggcctccccagtggggaacaaggcggaccccagagggccaggacacagtaggggctgaggatgcctggtgaatggatgcctgggagaatggatgccagaattcacacacgaggccatgaacagggctgggaaaacttccaaacacagggaagcacgtgtcttggtgcaccttgtgatgcttcaacagcaggactgagacggggacatttacagtgaacagaaatgtgttggctcgagttctggactccaggaagtccaacgtcaaggcaccagcaactttccagggcctgcgagctgcacagtcacatgggggtgaaggttgttgccagaagctcaggggatgctccagacagagtggcctgggatgtcgagtcactggtgctccgtgacatggggacaagaggaagcagtttagtctgacatactgcccccccagctagagggcaagagacagaaagaggggctgaggtcacctttgaataaccacagcagtggcacccacaaaggtgcagtccccacagcctcatagcctcttctaggtgccacctcttaaggccagtaccatagcaattaacactgaaggtcagcttggagcagacaatcactcaaaccaaacaggggggatggaggaaaggagcttcaatggcaagatcccctgggctcctgtcctggcccctcctccccctgccccaccccgcacccctcctgttcccccgtcccagagcttcccctgcccctgctcctctcccaggtgtatttccggtttgagaaccacgcagaaatgtgcttcttatcttggttctgtggcaaccgactgcctgctaacaggcgcttccagatcacctggtttgtatcatggaacccctgcctgccctgtgtggtgaaggtgaccaaattcttggctgagcaccccaatgtcaccctgaccatctctgccgcccgcctctactactaccgggatagagattggcggtgggtgctcctcaggctgcataaggcaggggcccgtgtgaagatcatggactatgaaggtgagaggtgcaggggtcaggggagcatgacggggaggaacagcctcagagatggatggatctgcaatgccatggctgggggtgttccagggcagcctgcaggggtggggctggcactgattgcaactgacagccaggagaccaggcctgggagggcaggcccagggtcaggggagagcctgagtgcttcccacctcttcatctcagactttgcatactgctgggaaaactttgtgtgcaatgaaggtcagccattcatgccttggtacaaattcgatgacaattatgcatccctgcaccgcacgctaaaggagattctcaggtgagggtctccctctggcctcatcgtctctctcctctcgcctcctgctcatcctcctgaggactcccctggctgggccctcctgccctccgtcctgcccccctgcctgccctcatggttacaccccctcacccacactcctcatgctccctccaccttggtgcctcccccctgctttcctgggctcttcctgtgagtgagaggccccttctgcctccagagcgacctccatccacccccgaggctgccctccccacagcctgggagccccaacctggctccttctatctccctggcataaccgaatttgtcataaaactggacgtagtaagtgggcatgaatagtcacaagcccgacagtcggaagctttgagcaacatccttcaaggccgacctgagcccctgagaaggagccgccaccatggaaacagagcttcaggcttccgcggccatagaagatgcccccgggccgggtgcccacagggcaggcatttattttctcacagatctggaggctgcaagtccaaggtggaggggtgggtggggttgtgtcctctgtggccgctcctcctggctggcagggggtcccttccagccctgtcctctctggcctttcctctgtgcacctgcactcctggggtctctctgcctctaaatgtcctccttgtttatggaccccagtcagacaggattagggcccaccctaagggccatgagttaatttaatcaccactttagtgtacttgtctccaaatacagttatcctgtgaggaggtggggttgagggcttcgacatgtcaatgtagggaagatacaatttagcccatgacaatgacccagggggcttgggtcaagcttgggtggggtgtgcaggggtccccgttctgtgtgtctgtctcccaggcgagtcctgccctgactcccacagcccctccctccagaccatggcttccccacctaacagcacctagctgggcctccggctcacgcctgtcccttctcaaatccctcccacagggatggagatgcagaaagagtcaagcaaacactcagtgatcaaggtcccatttgagtaaggtttttttgtttttttttttttgagacagcgtctccctctgttgcccaggctggagtgctgtggtgcgatctcggctcactgcaacctctgcctcccggttctagcaattcccttgtctcagcctcccaagtacctgggattacaggctcatgccaccatgccggctaatttttgtatttttagtagagacggggttttgcaatgttggccaggtgttgagtaagattttacaaaagagtaggcttggatcatgggaggcttgagatgctaggagctctccaggaagcacaacagaaaagggcaaccagggaccagagaggccctagaaagagatctaaggccctcgggagagatgggaactgagcacctgggtcttagaccggaggagcaaactgcaagacagggtggccggggacaccagcctccgcccttctgtgacatagggacaagagctcagcctgccagggaacaactctgggcaggagatgtggaaggaaggagctcagtgtgggggcacgcatggcatcctggggggacatctgagggcacccccacccactattcctccctccaatggtggcctctgagtgtgaaggcaagggggaagcagacacctgcccctcactctccctccctaccacatagctaccgggtggggggcgtccctgggatgattcctgagggcaggatccaggggtccctccggaggtcctcccatccaggtgagaaagcagcataaagtgaggcctgcactcagatgggcctgggaggtcactcacagcgcaggtgtctcctggaacaagggccctggacgatagaaatagaacccaagcccaggactaaaatcagggccaggacaagcctgccagggaggctacacatgaagcctcagatcagggaccactgcccgttctgcccatggggcctctgctgccccttcctgcctggtggccctgctgggcctcagccctggcctccccctgccccagccctgggctccctcccctctggttcctctgctgctcccactaccagccaggctctttgccctgctatgtggtcgccccactgctgcttctgaatgggccatctcccccacctgccccagcccatgccccctgctgagattctcccctgagagtcatgcccgggctggtgctccccgccttgggagggtgctccctctgtgtgcttcccgccattcctgagctcaggaactgggagaattgaaccaaaggatgattggagcaatcaggcattttattctcagcactttggtggaatttctgtaagatttactttgtttcaatacaaagtcttaagagagggtgtgggggaggaaatggtctctgtaccagaaaataagtcatttcttccaaagacgcctccgctgtgagcagagtaggatgcacacgaccccagacacaggctcctcctccgtgagcaccattcaccttttagaatgacacctgcaacatggagtgtaggaaaaaatatgatcaggagaaatgctcttattttaaagtttagtaagaagacagcgtggttgcctacagctccccaccgcagggcctgcgatgcagaggctggacagggctggcctcgaaaggggccccagctccatccaccgccccagctctgtggtgtgggcagattatctggcctccctatgcctctggcacctcctctgtaaaatagggatggcccctgcaggcctcaggcacatgccatgagctcagacatatgcagcacttaggagagtagcctggaccggccgggctcagtggctcatgcctgtcattccagcactttgggtggttgaagcaggcagatcacgaagtcagttcaaaagcagcctggccaacatggtgaaacatgatctctactaaaaatacaaaaattagggccaggcgcggtggctcacaccggtaatcccagcactttggtaggccgaggtgggtggatcacaaggtcaggagttcaagaccaccctggctaacgtggtgaaaccccgtctctactaaaaatacaaaaaattagacgggcgtggtggcatgcacctgtagtcccagctacttgggaggctgaggcaggagatttgcttgaaaccaggaggcggaagttatagtgagccgagattgcaccactgcactccagcctggtgacagagtgagaccgtgtgcaaaaataaataaattcgctgtgatcccgatataaaaataatcatcatcatcatcggacaggtgaaatgtgaggaaggaattgagctgaaatgttcaagcaattatttcagggtgaagagttttattctctgttgcattttcctaatgggttgggagatgtgtggcagaaaaactgggaggttgagggtgtcccattggtaggcccagagctggggttccagctaggagaggtcaccctgtccctgctgcccctgccagtaccccctcctctttctctctcccagtcttcctgcctgggaaagcagcagacattcccagggctgtggagggatgggagaggcccagactccagggacgtccagggagttgtgttcagtgggcatcagctccgaggaatctctgcactggggtttctctcttgtgccctcagaaacccgatggaggcaatgtacccacacatattctacttccactttaaaaacctactgaaagcctgtggtcggaacgaaagctggctgtgcttcaccatggaagttacaaagcaccactcagctgtcttccggaagaggggcgtcttccgaaaccaggtagcaccaaagtcctatttacaccctaaataggagctaagcagctgggaacgcagaaaacacaatacgtgacgtgccccgcgtgggctctgctatgtgtactttcctcttacatttctttcttttttttttttttaagacagagtctccctcatgcaacctctgcctcccgggttcaagcgattctcctgcctcagcctcatgggtagctgggattacaggtgcccgccaccacactcagctaatttttattttatttatttatttttttagtagagacggggtttcaccgtggtggccaggctggtttcaaactcctgacctcaagcgatccgccccgcttggcctcccaacgttctaggattacaggcatgagccaccacgcccaacttcctcccacattttttaagtcggtggcccagatcttcctccctaactttcctgggatcagattgtcgaggggttttgcctcttaccaaaaggccttgtttagcgcccagcgccctcactcttgactttgtttcccaaaatcttgtcatggagctgtgcgtccggcagtcctcgggaaacagcagctgtgggaagcggtgggtctggtgtccagcactgtgcctgggccagtcactgtgggctggtggggccgcccccgccactgccctgattcctcgatgtcaaggacacatcctcacagggtggtgaaccctcgctcctcaccctgccgcccccacagcagccactgacctcccacccaccctgccgtgtcccacccaaccctgcggccccctcctcccaggcaggagattttttcagagtgtgtttggggagggagccgtctgtgtgctgggcaggcctggcctacagcagtgctggcctcggaaacacccaggactcaggatggaagcgcaagtgtttccagtccccacacgctaaaaaggcgataagaactcgtggaagaaattttagtgtctgcattagctcaattatctcacataggatttcaacatatacttaatataaaatgcctcatgagagagttaaagtttgtctattctcacaatgagattttgaaatgcgctgtgtattttacacgtgccaacgtttctaatcagagccccatttcaagtgctcagtagcccctttggccaaccttcaactccatgggacaatgtgggtccaatgaccttcccagcagaaggcagacaggggacaaggcagaccccataggaccaggccacagcaggggctgaggatgcctggttaatggatgcctgggggaaaggatgccagaattcgcacttgagggcatgatgagacaggaaaagactcaataaaataaagaaggaaggggccaagcgcggtggctcacgcctgtacgcagtagctcacgcctgcaatcccaacacatcgtgaggcctaggcgggcggatcataaggtcaggagttcaagaacagcctagctaacatggtgaaaccctgtctctactaaaactacaaaaattagccaggcgtaggagtgcgcgactgtaatcctagctactccggaggctgaggcaagagaatcgcttgaacccaaggggcagaagttgtggtgagctgagatcgtgccgttgcactcccgcctgtgcaacagagcaagactccatctcagaaaaaaataataaaaaaataaagaggaaggagaaggatggaataagggaaactcaatgaataaaacgccctggggcctactatgcacccagaaaaatgaaaagtaaagaaataaaataaggtcgtgcatgtggtttatgctcatagtcctagaaatttggtaggctgaggcaggaggatggcttgagcccaagatttcgagatcagcctgggcaatgtggcacgactccgtctccacaaaaattacaaaaaaattagccgggcgtggcagcacacacctgcagtcccagctaatcaggaggctgaggtgggaagattccttgagcctgggaggtcaaggctgcagtcagcccagatcgcaccactgcaccccagcttgggcaacaggagagaccctgtctcaaaaataaataaataagaaaatgccctggggcttcaggcctgccctcttctcccatcgccccacccctacactcctcctgctcctggtctgagctccccctgccctcctcctcctccttccccaggtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctgctacttctgggatacagattaccaggaggggctctgcagcctgagtcaggaaggggcctccgtgaagatcatgggctacaaaggtgagacgtggggggctgaggagagtgggtgcgggagggacagcatgaggggcaggtgggtctgcaatgccgtggggcggggcagtgtccccgggaagcctgcagggatggggccggcgccagctgcaactggcagccaggagacctggcttgggaggggagggcccagggccgggagagaggcttgctgggccctcactgctttctccttgtttttttctcagattttgtatcttgttggaaaaactttgtgtacagtgatgatgagccattcaagccttggaagggactacaaaccaactttcgacttctgaaaagaaggctacgggagattctccagtgaggggtctccctgggcctcatggtctgtctcttctagcctcctgctcatgctgcacgggcctcccctccatcctgcaccagctgtgcttttgcctggtcatcctgagcccctcctggcctcagggccattccatagtgcccccctgcctcaccacctcctccccgctctcccaggctcttcttgtagaggctctccatccacctccccagtcctgttcccccagcctgggtgcccctaacttgactcttcccatctccccagcataaccaaatcttttttttttttttttttttttgagacggagtttcactctgtcgcccagactagagtgcaatggctggatctcagctcactgcaaactctgcttactgggttcaagtgattctcctgtctcagcttctgagtagctgggattacagatgcctgccaccacgcccagctaatttttttttttttttttttttttttttgtatttttagtagtgactgggtttcaccatgttggccaggctggtcttgaactcctgacctcaggtgatctgcccatctctgtctcccaaagtgctgggattacgggcgtgagccacccggctcggccgcacaaccaaatcttattaaactcaatctagtctggccctggtgactcacgcctttcggaggcagaggtgggagaatcgcttgagcccagaagtttgagaccagcctgggccacacgacaaagccccatttctacaaaaaaaaataccaaaaaaaagccagatgtggtggcatgcacctgtagtttaagctacttgggaggatgaagtgggaggactgcttgagccggggaggtggaggctggagtaaactgagatcgcgccacagaactccagtttgagcaacagatcaagaccctgcctgaaaataaatcaataaatacactcaacctaaatggatatgaatatatgtaagttgaaaaccagttttgagaaacatcctttgtaagtttcatcctacgaattgggtcattcatgtcctacgcagctaaaacagaggccagcagccagggaggaaaagcagtcaggccacacaccattgctcccaaaatggacttatctgcaagcctgactcctgaaactgtgcattgtaccctgaaaccagctttatccatagcttctgccataaatggctgtaagtcttggactccttgctccaaacgcagtgactcagcaatggaacctcccagctcccaacacttcctagtgcccatggtgggctttcccacagggcaagagaacatttctcctttttttttttgaagtggagtctcgccctgtcacccaggctggagtgcaatggcgcagtctccgctcactgcaacctccacctctgttgttcaagtgattctcctgtctcagcctcccgagtagctgggattacaggcgtgcaccaccacaccgggctaatttttgtattttcagtaaaaacgggtttcatcatgttgcccatgccaggcttatttttatttttttcagatgaagtcttgctctgtcacccaggctggagtgcagtggtgcaacctgggctcactgcaacctctgccacccgggttcaaactattctcctgcctcagcctcccgagtagctgggattacatgggtgtgccaccacgcctggctaatttttgtatttttagtagagatggggtttcagcatcttggctaggctggtcttgaactcctgacctggtgatccacccgtctcgggcacccaaagtgctgggattacaggtgcgagccacctggccaggcttaggctggtcttaaactcctgacctcaagtgatccgacctccttggcctcccaaattgctgggattgctggtgtgagccacagcgcctagcccatttctcctttttataaaacctgttgctgtctctgttctcccaacatggtgaacaccacccagactgcgtgtatgtcccaaattctttctttgcaaatgaaatgtgaaattagaggctcttctccacactttaaatttgacttgtcattttctaggcagatgtaagttattagagaatgagattctctataaaaatgaccccttcatgctgtggcctccacagaacatgccccaggccaggtgcccacacagcaggcatttatttcctcacacatctggaggctccaagtccaagttcgaggggtgggttgggttgtttgctctgaggctgctcctcctggctggcagggaatcccttctggctgtgtcctctgtggcctttcctctgtgcacctacctgcacctctggggtatctctgcctccaaatatcatcttttttttttttttttttttttgagacagagttttactctcgttgcccaggctggagtgcaatggcataatcttggctcactgcaacctccaccttcagggttcaagcgattctcctgtctcagcctcctgagtagctgggactacaggcatgcgccaccacgcccggctaattttgtagttttagtagaggcgaggtttctccatgttgctcaggctggtcttgaactcgtgagctcaggtgatccaccctcctccacctcccaaagtgctgggattacaggtatgagccaccgtacccggcctttttgttttgttttgtttttgtttttgtttttgtcttgagacggtgttttactctgttgcccaggctggagtgcaatggcatgatcactgctcactgcaacctccgcctcccaggttcaagcaattctctggcctcatccttctgagtagcggcgattacaggcgcccagaaccactctctgctaatttctgtattttttagtagagatggggtttcaccatgttggccaggctggtctcgaactcctgactgcccacctcggcctcccaaagtgctgggattaaaggcatgagccagggcacttggccacccttctccttgatggacccccgccaagtgaatttgtgcccacactagaggtctcgtttaaattaatcatcttggccgggcgtggtggctcacgcctgtaatcctcccactttgggaggctgaggctggcagatcacttgaggtcaggagttggaaatatgcctggtcaacatggtgaaaccccgtctctactaaaaatacaaaaaaattagcagggcgtggtagtggatgccagtaataccagctactcgggaggctgaggcaggagaatcgctggaacccgggaggcagaggttgcagtgagctgagatcgtgccattgcactccagcctggaagacacagtgacgctgcatctcaaaaaaaaaaaaattaattaattagttaatcatctgttggctgggtgcggtggctcacgcctgtaatcccagcactttgggaggctgaggtggcggagttggaggtcagcctggccaacatggtgaaaacccacctctactgaaagtgcaaaaagtagctgggcatggtagtgggcacctgtaatcccagctactcgggaggctgaggcttgaatcacttgaaccagggaggcagagtttgcagtgagccgacacggtgccactgcactgcagcttgggcgacagagtgagactccatctccaaaaaaattaattaattaattaactaatcatctgttgaaaaggacctgtctccaaatacaaccacacattgaggtagaggggttagggcttcagtatattgatttttgggagaaacagggcaacatggcaacaagccacagtcactgtgggcgggcctgagtggggagtgcaggggttcctgtcctgtgtgtctgtctcacaggggagtcctgacctgaccctcacagcccctccacccagaccttcctgcatgttccacccagcccaccctcctgcacccaagagcacccagccctcccttctgctcatgcccctcccttctcaaatccctcccagcagtgcagctctgggctaggacacagcctagggaacgtgactgagaaagagccaagaaaacttgatcagtgatcaagttggtgtttaagtaagattttcaataaaaagtagaattgggtactacatggaggcttgagatgctcagagcttttcgagaaagcagaacagaaagtagaagggcaaccaggaaccagaggtgccagagaactggaagcgcgggccctccgaggagacagggagtgggcacctgggtcttgggcctgtcgacaaaaagagtcaaactctgtaaaatatttgaagagacgtattctgagccaaatacgagtgaccatggcccgtaacacagggctcaggaggtcctgagaatgtgtgtgtgctcaaggtggtgtgggtgcggcatgactccccagaccccttagataggaatttggttttatatattttagagaagcatcagctatcaatcaaacacatttaagaaatacagaagctgagcgtggtggctcacgcctgtaatcccagcattctgggagactgaggcagatggatcatgaggtcgggaattctagaccagcctggccaacatggtgaaaccccgtctctactaaaaatacaaaaaattagccaggtgtggtgctgggcacctgtaatcacagctactcgggagactgaggcaggagaatcacttgaacccaggaggcagaggttgcagtgagccaagatcacgccactgcactccagtctgggcgacacagcaagactccgtctcaaaaaaaagaaaagaaatacttcggattgctccagaaaggtcggacggctcaaagtgagggcaggagtgctggggggcttccaggctacaggtaaatttaaacattttctggttgacaattggttgagtttgtctagagacctggcatccatagaaaggaaacgttcaggttaagataaaagattgtggagatcaaggttcttttgaagtctcatagtggctgcccttagagacaatagatgacaaatgtttcccattcaggcctttaaaaggtgcaattagttcatctgtttaggaccgggagggcctagaagaaaaagatccagctatgttaatagagattctttacagatacaaattttgccccacaaaggacaactttgcagggccatttcaagatatggcaaagaaacatgttttggggtaaaatattttgtctttttactttgtcacataatgttgtgcctgagtcagattggaaagtaactcacaatatatagggttaaataaaacccatgtgggccgggcgcagtggctcatgtctgtaatcccagcactttgagaggcctaggtgggtggatcacctgaggtcagcagttcaagaccagcctggccaacatggtgaaaccctgtctctactaaaaatacaaaaattatccaggtgtggtggcgggcacctataatcccagctacttgggaggctgagacaggagaatcgcttgaacccgggaggcgaaggttgcagtgagccgagaccacaccattgcactccagcctgggcaagaagagtgaaactcggcctccattaaaatacaataggaaaaaaaaaaaaaaaaatagaacccctctgatgaggatgtacgggttgtaaggcatgactccccagaccccttagataggattttgggcaagattaaataaaaacaaatcagagcttagtccaaaggcctatgaactaaaaataaagtctttagcccccaccgatcccccccaactttggcccccagtggccaggggtatctcagaaaaaccttaaaactgagttcccagccatgatgggaggggaggtcaggcacgcctcattatcaccccgcccttttgcagtttagacacaactgaccagcagtaatgttaaaacagaatcataagatgggcagaaccagaacagactcttcatggcaatcagataccaaatcacaaccaggacctcaggccgtgccaggcaagggtgagatcacacaccccacacttaaacagtcaactctgttctgcctgccccaaggttttttttttttttttttttttgctctagcagctaaacaagcactgcctccagataaagatgaaaacaatcacagctcacccagcgcccggacgcggagcaacagagcccctgctccacagccctaattccaggtttccctggacaagagactgatttcagtaactttctccagatcggaagaccacggaccacggactagttctgaatggtttacagacctggcaaattttggtgccttcatgtcctgaaaggaccttttgacatacaggcttaattgtggtacatttaaatgttgtctccaccgcaatgtgaggacggattatacggttgctttttttttttttagatttttgtttgtttgttttttgttttgagatggagtctcactctgtctcccaggctggagggcagtggcgcgatctcggcccactgcaacctctgccttctgggttcaactgattctcctgcctcagcctcccgagtagctgggatttcaggcacgtgccaccacacccggctaatttttgtagttttagtagagaccaggtctcaccatgttggccaggttggtctcgaactcctcactgtcatgcgtgtctgtatagaaaaccacctaaacaggctttgtgtaagcaataacgccatttattcacttgggtgcaagtgggctgagtctgaaaagagagtcagcgaagggagataagagaggggcagctttataggacttgggtaggtggtggaaagttacagtcgaaggtggtcatctgttgtcagcaggggagggggtcaccaggtgcatggtgggagaccatgagacccattgtccagaagaagaatgtcataaggtcgattgatcagttagggtagggcaggaacaagtcctaatggtggaatgtcttaaggttggttaatcagttaagggagaaactggctgtttcacttcttttgtgtttttttggctgctccagacttcttggctgctgcaggccatctggatgtatatgtgcagttcacaggggtcacaatggcttagctccggctcagaggcctgacactgacctcagatgatccacctgcctcggcctcccaaaatgctgggattacaggcgtgagccactgtgcctgcctgggatcatatgttacacgcatgtttgttcaataagcatggagtgcagccacccacatgaatattcatagctcctcctatagcctgttgaatatgtatgtttagccaaccccttcagcataaagctcctgccccaacccctcctgcttctaaatgtctgtctctggtgtttcccagaggctgctcttcccaggctgcgggatggctaccttgctgcctgtcacccttaacaagaaataaaatctcctttccaaatttatacattgtggccaggcgcggtggctcacacctgtaatcccggcactttggtacgccaaggcgggcggatctcctcagatcgggagttcgagatcagctgaccaacatggagaaaccctgtctctactaaaaatacaaaaattagccaggcatagtggtgggcggctgtaagcctgaccaacatggagaaacactgtctctactaagaatacaaaaattagcctaggcgtaggggtgggtgcctgtaatcgcagttacatgggaggctgaggcaggagaatcttttgaacctgggaggcaaaggttgcggtgagctgagattacgccactgtactccagcctgggtaacagagcaagtctccgtctcaaaacaaacaaacaaacaaaaaaacacaaaaaaacaaaagcaaacaaaaaaaccaaatgcatcccttgtgtaatttttaggtcaccgcgccatgggaacacgctaccaggggaagggagctgtgagacgcgcagggaggctccagacaggctggcctgggacaccagccactgctcttccatgacatggggacaagaggaggcgagagctcagcccaccagggaggaactccgggcaggagatggggaagaaggagaagcaggaaggaaagagctcagtgtgggggcgcgcatggcatcccggtgggacatctgaggcccacacccacctgctgtccctccctcccacggtggcctccgagggtgaaggcctggggagaggcagacacctggccctttactctccctccctgtccccatggccgctgggtgggggccgtctctgggatgatccccgagggcaggatccgggagtccctgcggaggcatcagcctgtctgtcttgatggtggagaggaggctccagctgggcgggaccaccaggggaggggcttgtgctctgctggctcagcctggtgtggacccacctcgcgggcgctggctgcaatgactttctctttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagggggaggggccatgactacgaggccctgggaggtcactttagggagggctgtcctgaaacctggagcctggagcagaaagtgaaaccctggtgctccagacaaagatcttagtcgggactagccggccaaggatgaagcctcacttcaggtaccgctgcccgctctacccgctgggcccctctgctgccccttcctgcctggtggctctgctgggcgtcagccctggcctccccctgccccagccccagccctgggctccctcccctctggctcccctgcccccgccactcccagccaggctctttttcctgctctgtggttgccccactgctgcttctgaataggccgcttccccacctgccccagcccaggtgccctgctgagactctcccccgccaccgaaagtcatggcagggctggtgctcccggccctgggagggtgctccctctgtgttctttccgccattcctgaactctggaactgggagaattgaaccaaaggatgattagagcaatgtggaattttgttcacagtgctttgatggattttctgtaacatttactttgcttaaatagcaagtcttaggagagggtgtggggagggaatggtctctgaagcacaagataaatcgtatcttccaaggatgtctccactgtgggcagaggaggatgcagatgaccccaaacacacgctcctcctccactatcagcattcactgtttataaatgacacgagtaacatggaatatagtggccgggtgcggtggctcacacctgtcatcccagcactttggtaggctgaggtgggtggattgcctgaggtcgggagttcgagaccatcctgatcaacatggataaaccctgtctctactaaaaatacaaaattagccgggtgtggtggcgggcgcctataatccagctactccacaggctgagacaggagaatcgcttgaacccaggaggcggaggttgcagtgagccgagatcgccccatcgcactccagcctgggcaacaagagccaaatttcgtctcaaaagaaaaaaaaacaaaaacaaaaaacatggaatatatgggaaaaaaactcaatgatcaggagaaatgctattattttaaaatttagtaagaagagagtctggtccccaatggctccctcctgcaaggctggtgacacagagactggacagggctggtctggtaagaggccccagccccatccgtccccagctctgtggcctgggcaggttaccccatctctctgcgcctctggcacctcctctgtaagatgggaatggcccgtgcgggcctagggcagcctcacatgagctcacatccgcgcagcacttagaagagtggcctgggcctcagaattcggttctaccatgatttaacaatagtaatatacagaggtgaaatgtcagaaggaactggctgaaaggttaaaatctattattttggggtgaatagttttattctctctctcttttttttttttttttttgagatggagtttcgctcttgtagcccaggctggagtgcagtggcacgatctcggctcactacaacctccgcctcccaggttcaagcgattctcctgcctcagcctccacagtggctgggattacaggcacccactaccacgcttggctaatttttatatttttagtagagactgggtttcaccatgttggtgagactggtctcaaactcctgacctcaagtgatgggcctacctcggcctcccaaagtgctgggattacaggcatgagccataatgtccagccaagaactttgttctcttttgcattttactaatgcgttggagaatgggtgggagaaatactgggaaggtggggaatgtactcctggaacgaccagagctggaccctgagctggaagaggtcagcctgcccctgctgcccatgccagcatccccttttcttgctctctccccggtcttcctgcctgggaaggaagcaaaaattctcagggctgtggaggggttggggaggcccagagccatgcagggggctgtgtttagtggacatcagccctgagggctcccgggagcgctctctacattggctggtttctctcttgtgtcttcagaaacacagtggagcgaatgtatcgagacacattctcctacaacttttataatagacccatcctttctcgtcggaataccgtctggctgtgctacgaagtgaaaacaaagggtccctcaaggccccgtttggacgcaaagatctttcgaggccaggtaccacccggacttcaatcactttgcaggcaggagctaagccagctgggaaagcaaaccacgcactgataagtgaagtgcccggcggcgggctatccagtgtgtccttctctcccacactttccaagtccgtggccctgaccttcctgctggaccgtcctgggatcggatcgtggagggggtttgcctttgcacaaaaggccttgtgtttttttttttttttttttgagacagagtttcactcttgttgctcaggctggagtgcaatgacgcgatctcggctcacagcaacctctgcctcctgggttcaagcgatgctgtcgcctaagactcccgagtagctgggattacaggtgcccaccaccacgcccagctaattttttttttttttgtatttttagtagagacaggattttaccatattcaccaggctggtctcgaacttctgacctcaggtgatccacctgcctcggcctcccaaagtgttgggattacaggtgtgagccacagcgccggcctaattttaatatttaattaatccaatgtggctaacatattacttcaacattaattaacataaaattcttgacaagataatgaagtttctttttgtcacactgagtctttgaaatgagctgtgtaggccacgcttggtgggtggctcgcgcctgtaatcccagcactttgggaggccgaggtgggtggatcacctgaggttagatgtttgaaaaccagcttggccaacatggtgaaatcccgtctctactaaaaatacaaaaaaaaaattagcccggtgtggtggcagtcgcctgtaatcccagctacttgggaggctgaggcaggagaaccgcttgaacccatgaggcagaggttgtagtgagccgagattgcatcattgcactccagcctgggcaacaagagtgaaactacgtctcaaaacaaaaacaaaaaacaaaaaaagataaatgagcggtgtatggtgtatttttcaggtgcccaggtctttcatcagagccccatttcaagtgctcagtagcccctttggccagtgcgccccaccacatgggacagcgcaggtccagtggcctccccagctgaccgcaggcagggaacaaggcagaccctagagggccaggccacagcaggggctgaggatgcctggtgaatggatgcctgggagaatggatgccagaattcacgcatgaggctctgaacagggctgggaaaacttccaaacgaagggaagctcatgtcttggtgcactttgtgatgatgcttcaacagcaggactgagatggggacatttacaataaacagaaatgtatgggctcgagttctggcctctgggaagtccactgtcaatgcaccagcaactttccagggcctgcgagctgcacagtcacgtgggggtaaaggttgttgccagaagttcaggggatgctccagacagagtggcctgggatgtcgagtcactgctgctccatgccacggggacaagaggaagcagtttagtctgacatactgcccccccagctagagggcaagagacagaaagaggggctgaagtcgcccttgaataaacacgccagtagcacccacaaaggtgcagcccccacagcctcatagcctcttctaggtgccacctcttaaggccattacaatagccattaacactgaacgtgagctttggagcagacaatcactcaaactaaacaggggggatggaggaaaggagcttcaatggcaagatcccctgggctcctgtcctggcccctcctctccctgccccacccctgcactcctcctgctccccctctcagagcatcccctgccccctgctcctctcccaggtgtattcccagcctgagcaccacgcagaaatgtgcttcctctcttggttctgtggcaaccagctgcctgcttacaagtgtttccagatcacctggtttgtatcctggaccccctgcccggactgtgtggcgaagctggccgaattcctggctgagcaccccaatgtcaccctgaccatctccgccgcccgcctctactactactgggaaagagattaccgaagggcgctctgcaggctgagtcaggcaggggcccgcgtgaagattatggacgatgaaggtgagaggtggaggggtcaggggagcgtgagcgggaggaacagcatgaaagatggatggatctgcaatgccatggctgggggtgtcccagggcagcctgcaggggcggggccagcactgacagcaactgacagccaggagaccaggcctgggagcgcgggcccagggtcagggcagagcctgactgcttcctgcctcttcgtctcagaatttgcatactgctgggaaaactttgtgtacagtgaaggtcagccattcatgccttggtacaaattcgatgacaattatgcattcctgcaccgcacgctaaaggagattctcaggtgagggtctccctctggcctcatcgtctgtctcctctcgcctcctgctcatcctcctgaggcctcccctggccaggccctcctgccctccgtcctgccccctgcctgccctcatggttacacccctcacccacactccttgtgctccttccccttcttgcctcctccctctttcctgggcccctcctatgagtgagaggccccttctgcctccagagcaacctccatccaccttcgaggccgccctccccacagcctgggatccccaacctggctccttccatctccctggcataatcgaatttgtcataaaactggacgtaagtgggcatgaatattcacaaggccgacagccagaagctttgagcaacatccttcaaggccgacctgagtccctgagaaggagcagcctctgtggaaacttcaggcttcgactgccatagaagatgcccccgggccgggtgcccacagggcaggcatttattttctcacagatctggaggctgcaagtccaaggtggaggggtgggcggggttgtgtcttctgcagctgctcctcttggctggcagggggtcccttccagccctgtcctctctggcctttcctctgtgcacctgcacccctggggtctctctgcctctaaatgtcctcctcgtttatggaccccagtcagacaggattagggcccaccctaagggccatgagttaatttaatcaccactttagtggacctgtctccaaatacagttatcctgtgaggaggtggggatgagggtttcaacatatcaatgtggggaagatacaatttagtccatgacaatgggtcaagcttgcgtggggcatgcaggggtccctgttctgtgtgtctgtctcccaggcgagtcctgccctgactctcacagcccctccctccagaccttgctgcaccctgggccccaccccatggcttccccacccaacagcacccagcccggcctctgctcacgcctgtcccttctcaaatctgcccccaacagggatggagatgcagaaagagccaaacaaacactcagtgatcaaggtcccaattgaataagattttttttttttttttgagacactgtctccctctgtcgcccaggctggagtgctatggtgcgatctcggctcactgcaatctctacctcctggttctagcaattctcttgtctcagcctcccaagtacctgggattacaggctcatgccaccacactggctaatttttgtatttttagtagagacggggttttgcaatgttggccaggtgttgagtaagattttgcaaaagagtaggcttggataatgggaggcttgagatgccaggagctctccaggaagcacaatagaaaaaggcaaccagagaccagagaggccatagaaagggatctaaggccctcgggagagacgggaactgagcacctgggtcttagaccggaggagcaaactgcaagacagggtggccggggacaccagcctccacccttctgtgacatagggacaagagctcagcctgccagggaacaactctgggcaggagatgtggaaggaaggagctcagtgtgggggcacgcatggcatcctggggggacatctgagggcacccccacccgctattcctccctccaatggtggcctttgaatgtgaaggcaagggggaagcagacacctgcccctcactctccctccctaccacatagctaccgggtggggggcgtccctgggatgattcctgagggcaggatccaggagtccctctggaggtcctcccatccaggtgagaaagcagcataaagtgagacctgcactcagatgggcctgtgaggtcactcacagcgcaggtgtctcctggaacaagggccctggaagataaaatagaacccaagcccaggactaccatcagggccaggacaagcctgccagggagggtgcacatgaagccccagatcagggaccactgcccgctctgcccacggggcctctgctgccccttcctgcctggtggccctgctgggcctcagcctggcctccccctgcccctgccccagcgctagtctctctcccctctggttcctctgctgctcccactaccagccaggctctttgccctgctatgtggtcgcccctttacagcttctgaatgggccatctcccccacctgccccagcccaggccccctgctgagactctcccccgaaagtcacccctttgctattgctccccgccctgggatggtgctccctctctgtgcttctcgccattcctgagctcaggaactgagaaaattgaaccaaaggatgattggagcaatcaggcattttgttctcagcacttccatggaatttctgcaagatttactttgtttcaacacaaagtcttaggagaggatgtgggggagggaatggtctctgtaccagaaaataagtcacttcttccaaagatgcctccactgtgaacagaggaggatgcacatgactccagacacaggctcctcctccgtgagcaccattcaccttttagaatgaaacctgcaacatggagtgtaggaaaaaatatgatgatcaggagaaatgctcttattttaaagtttagtaagaagagagtccggttcccaacagctccctcctgcagggcctgtgatgcagaggctggacagggctggcccggaaaggggccccagctccatccatccccatctctgtggcctgggcaggttaccccgcctctctgtgcctctggcacctcgtctgtaaaatagtgatggccccctgcaggcctcaggcacataccatgagctcagaccctcacagcacttaggagagtggcctaggctggccgggcacagtgactcacgcctgtcatcccagcactttgggaggctgagtcgggcagatcacaaggtcaggagttcaagaccagcctggccaacatggtgaaacccagtctctactaaaaatacaaaaactaggtctggccgcgatggctcacacctgtaatcccagcactttgggaggcaggcgggcagatcacaaggtcaggagttcaagaccatcctggctaacatgatgaaaccccatctctactaaaaatacaaaaaattagccgggtgttgtggcacgtgcctgcagtcccagctagttgggaggctgaggcaggagaatcgcttgaaaccaagaggcagaggttgcagtgagccgagattgtgccactgcactccagcctggcgacagactgagaccccgtataaaaataaataaataaataaaagtacaaaaatcagccggacgtggtgacacaagctcgtaatcccagctactcaggaggctgaggcaggagaatcacttcaacccgggaggtgcaggttgcagtaagctgagatcgcgccactgcactccagcctgggcagcagagggagactatgtcccaaacaaaaacaaaaacaaaaaaaacaaaaagagtagcctgggcctgggaattcggtgtgataccaacgtaaaaagaatcatcatcatcggacaggtgaaatgtgaggaaggaattgagctgaaatgttcaagcaattattttagggcgaagagttttattgtctgttgcattttcctaatgggttgggagacgtgtggcagaaaaactgggaggttgagggtgtcccattggtaggcccagagctgtggttccagctgggagaggtcaccccggcccttctgcccctgccagcatcccctcctctttctctctcccagtctttctgcctgggaaagcagcagacattcccagggctgtccagtgagtggtgttcagtgggcatcagctccgaggaatccaggggggtctctgcattggggtttctctattgtgccttcagaaacccgatggaggcaatgtatccacacatattctacttccactttaaaaacctacgcaaagcctatggtcggaacgaaagctggctgtgcttcaccatggaagttgtaaagcaccactcacctgtctcctggaagaggggcgtcttccgaaaccaggtagcaccaaagtcctatttacaccccaaataggagctaagcagctaggaatgcagaaaacacaataagtgacgtgcctggcgtgggctttcctgtgtgtactttcctcttacatttcttttttttttttttttttgagacagagtctcactcagtcacccaggctggagtgcaatggcgtgatctctgctcactgcaacctctgcctcctgggttcaagcaattcttctgtctcagcctcctgagtagctgggattacaggtgcccaccaccacacccagctaatttttattccatttttagtagagacggggtttcaccgtggtgaccaggctggtttcgaattcctgacctcaagtgatccgcccccctcggcctcccaaagtgctaggattacaggcatgagccaccacgcccaacttcctcccacattttttaagtccgtggcccagatcttcctccctaactttcctgggatcagattgtcgaggggttttgcctcttaccaaaaggccttgtttagcgcccagcgccctcactcttgactttgtttcccaaaatcttgtcatggagctgtgcgtccggcagtcctcgggaaacagcagctgtgggaagcggtgggtctggtgtccagcactgtgcctgggccagtcactgtgggctggtggggccgcccccgccactgccctgattcctcgatgtcaaggacacatcctcacagggtggtgaaccctcgctcctcaccctgccgcccccacagcagccactgacctcccacccaccctgtcgtgtcccacccaaccctgcggccccctcctcccaggcaggagattttttcagagtgtgtttggggagggagccgtctgtgtgctgggcaggcctggcctacagcagtgctggcctcggaaacacccaggactcaggatggaagcgcgagtgttcccagtccccacacgctaaaaaggcgacaagaacttgtggaagaaattttagtgtctgcattagctcaattatctcacataggatttcaacatatacttaatataaaatgcctcatgagagagttaaagtttgtctattctcacaatgagattttgaaatgcgctgtgtattttacacgtgccaacgtttctaatcagagccccatttcaagtgctcagtagcccctttggccaaccttcaactccatgggacaatgtgggtccaatgaccttcccagcagaaggcagacaggggacaaggcagaccccataggaccaggccacagcaggggctgaggatgcccggttaacggatgcctggggaacaggatgccagaaatcacacatgacctatgatgagacaggaaaagactcaataaaataaagaaggaaggggccgagtgcagtggctcacgcctgtaatcccagcacttagcgaggctgaggcgggcggatcatgaggtcaggagtttgacaccagcctgcctaacatggtgaaatcccatcactactaaaactacaaaaattagccaggcgtgggggtgtgcccctgtagtcccagctacttgggtggcttaggcaggaaaatcgcctgaacccaggaggcagaggttgcagtgagccgagatcttgccactgccccccagcctgggtgacagagcaagactctgtcactcaaaaagataaagaggaacggccaggtgcagtggttcacgcctgtaatctcagcactttgggaggccaaggcgggggatcacgaggtcaggagcttgaaaccatgctcgctaactcggtgaaaccccatctctactaaaaatacaaaaaattagccaggcgtggtggcgggcgcctgtagtcccagctacttgggaggctgaggcaggagaatggcgtgaaccccggaggcggagcttgcagtgagcggagatcgcgccactgcactacagcatgggtgacagagcgagactcagtatcaaaaaaaaaaaaaaagaaagaaaaagaaaagaaaaaataaagagcaaggagaaggatggaagaagggaaattcaatgagtaaaaagccctggggcctagtatgtacccaaaaaaatgagaagtaaagaaaataaggccatgcatgtggtttatgctcatagtcgcagagttttgggagggtgaggcaggaggatggcttgagcccaagagttcgagatcagcctgagcaacatggtgaaacccagtctctacaaaaattacaaaaaaattaggcaggcgtggtggcacgcacctgcagtcccagctaatcaggaggctgaggtgggaagattccttgagcctgggaggtcaaggctgcagtcagccccagatcgcaccactgcaccccagcctgggcaacaggagagaccctgtctcaaaaataaataaggaaacgccctggggctccaggcccgccctctgctcccatcgccccacccctgcactcctcctgctcctagtctgagctcccctgccctcctcctcctccttccccaggtggatcctgagacccattgtcatgcagaaaggtgcttcctctcttggttctgtgacgacatactgtctcctaacacaaactacgaggtcacctggtacacatcttggagcccttgcccagagtgtgcaggggaggtggccgagttcctggccaggcacagcaacgtgaatctcaccatcttcaccgcccgcctctactacttctgggatacagattaccaggaggggctccgcagcctgagtcaggaaggggcctccgtggagatcatgggctacaaaggtgagacgttggggggctgaggagagtgggtgcgggagggacagcatgaggggcaggtgtgtctgcaatgccgtggggcggggcagtgtcccgggaagcctgcagggatggcgccagtgtccactgcaactggcagtcaggagacctgggcttggaggggagggcccagggctgggagagaagcctgctgggccctcactgctttctccttgttttttctcagattttaaatattgttgggaaaactttgtgtacaatgatgatgagccattcaagccttggaaaggactaaaatacaactttctattcctggacagcaagctgcaggagattctcgagtgaggggtctccccgggcctcatggtctgtctcctctagcctcctgctcatgttgtgcaggcctcccctccatcctggaccagctgtgcttttgcctggtcatcctgagcccctcctggcctcagggccattccatagtgctcccctgcctcaccacctcctctccgctctcccaggctcttcctgcagaggcctctttctgcctccatggctatccatccacccaccaagaccctgttccctgagcctgcatgcccctaacctgccttttcccatctccccagcataacctaatattttttttttttttttgagacggaatttcgctctgtcacccagactggagtgcaatggcttgatcttggctcactgcaaactctgcctaccaggttcaagcgattctcctgcctccgcctcccgagtagctggaattacagacgcctgccaccacgcacagctaactttttttttttttgtatttttagtagtgactgggtttcaccatgttggccaggctggtcttgaactcctgacctcaggtgatccgcctatctcagcctcccaaagtgctgggattacaggcgtgagccactggcccggcggcacaaccaaatcttattaaactcaccctaggctggccgcggtgactcatgcctataatcccccagcaatttgggaggcagaggtgagagaatcgcttgagcccaggaattcgagaccagcctgggccacatgacaaagccccatctctacaaaaaaattacaaaaaaaaaaaaaacaggtgtggtggcatgcacctgtagttgaagctacttggaaggatgaagtgggaggattgcttgagccggggaggtggaggctgcagtgaactgagatcacgtcactgaactccagtctgagcaacagatcgagaccctgcctgaaaataaatcaataaataaactcaaccgaaatgggtatgaaagttgaaatgggtatgtaagttgaaaaccagaagttttgagaaacatcctttgttaactttcatcctacaaattgggtcattcatgtcctacgcagctaaaacagagcccaggagccagggaggaaaagcagtcaggccacacaccattgctcccaaaatggacttctctgcaagcctgactcctgaaactgtgcattgtaccctgaaaccagctttatccatagcttctgcaataaatggctgtaagtcttggactccttgctataatcgcagctattcagcaatggaacctcccagttcccaacccttcctagtgcccatgggctttcccataggacaagagaacatttctccttttctttttttttttctttgaaatggagtctcgccctgtcacccaggctggagtgcaatggtgcggtctcggctcactgcaacctctgcctcccttgttcaagtgattctcctgtctcagcctcccgagtagctgggattacaggcgtccaccaccaaaccaggctaatttttgtatttttcataaaaacgggtttcatcatgtttcccaggctggtcttatttttattttattttttgagatggagtcttgctctgttgcccaggctggggtgcagtggtgcaatctgggttcactgcagcctctgccgcctgagttcaagctattttcctacctaagcctcccaagtagctgggattacatgcgcgtgccaccacgcctagctaatttttgtgtttttagtagagacggggtttcaacatcttgaccaggctggtcttgaactcctgacctcgtgatccacccgtctcggcctcccaaagtgctgggattacaggcgtgagccacctggccaggcttaggctggtcttaaactcctgacctcaagtgatccaacctccttggcctcccaaattgctgggattgctggtgtgagccacagcgcctagcccatttctccttttaataggacctgttgctgtctctgttctcccaacatggtgaacaccacccggactgcgtgtatgtcccaaattacaattctttctttgcaaatgaaatgtgaaatttagaggcccttctccacactttaaatttgacttgacattttctaggcagatataagttattagagaatgagattctctataaaaatgatcccttcatgctgtggcctccacagaagatgccctgggccaggtgcccacatgaataatgcgggccacaggcaggcatttattttctcacagatatggaggctacaagtccaaggtggaggggtcggcggggttgtttgctctgaggccgctcctcctggatggcagggatcccttctggctgtgtcctctgtggcctttcctctatgaacctgtactgtacctctggggtctctctgcttccaaatatcttttttttttttttcagacagttttgctcttgttttctaggctggagtgcaatggcacaatctcagctcactgcaacctctgccttccgagttcaagcgattctcgtgcctcagcctcctgagtagctgggactacaggcgtgtgccaccacgcctggctaattttgtagttttagtagagacggggtttctccatgttgctcaggctggtcttgaactcatgagctcaggcgatccactctcctcagcctcccaaagtgctgggattacagatataagccaccatacacaacttttttttttttttgagatggagtttcactctgttgcccaggctggagtgctaaatagcagaatcactgctcactgcaacctctgcctgctgggttcaagcaattctcccacctcagcctcctgagtagctgggattacagatgcccagaaccaatctctgctaatttttctattttttagtagagatggggtttcactgaggaaggagaccacctctctcattgtctcctatttcagaaggaagcaaaaagttagaaagatgcagaagtaagatcaatggccagactgtttggcgctgctacctgggcctggtagttaaagatcaactcctgacctgaccgcttgttttatctaaagattccagacattgtatgaggaagcattgtgaaactttctggtctgttctgctagcccccaccactgatgcatgtagccccccagtcacgtagcccacgcttgcacaatctatcacgaccctttcacgtggaccccttagaattgtaagcccttaaaagggccagggacttcttcagggagctccaatcttcagatgcaagtctgtcaacgctcccagctgattaaagcctcttccttcctaaaactggtgtctgagaggttttgtctgcaaccgttcctgctacatcaccatgtacattccaggcgaggctggtctcgaattcctgacgcccacctctgcctcctaaagtgctgggattaaaggcatgagccatggcacctggtcgaccttctcctttatggaccccagacaaattaatttgtgcccacactagaggtctcatttaaattaatcatcttggtcgggcgtggtggctcacgcctgtaatcctagcactttgggaggctaaggcaggcagatcacttgaggtcagtgtcacacgtgtccatgtgaagagaccaccaacaggttttgtgtgagcaacaaggctgtttatttcacctgggtgcaggtgggctgaaccagaaaaaggagtcagcaaagggtggtgggattatcattagttcttacaggtttgggataaacctatcccaaacctataagtgtacattcttaaaggcatacaaagtacattcttaagtgtgggggagaatattacaaagtaccttcttaagggcaggggagactatatggtatcagttggggtggggcaggaacaaatcacaatggtggaatgtcatcagttaaggctattttcgcttttttttgtggatcttcagttgtttcaggccatctggatgtatacatgcaggtcacaggggatatgatggcttagcttgggctcagaggccagacattcctgtcttcttatatgaataagaaaaaacaaaatagtggtgaagtgttggggtggcgaaaattttggggggtggtatggagagataatgggcgatgtttctcatggctgcttcaagcgggattaggggcagcgtgggaacctgtggtgggagagattaagctgaagaaagattttggggtaaggtgatattttggagttgttagaaggagcatttgtcgtatagaattattggtgatggcctggatgcggttttgtatgaattgagaaactaaacggaagacacaaggtctgaataaaagaaggagaaaaataggttggttttttttttttttttttttttttgagacagagtctcgctctgttgcccaggctggagtgcagtggcacgatctcggctcactgcaacctctgcctccctggttcagacgattctcctgcctcagcttcctgagtagctgggactacaggtgcacgccaccacgcccgactaatttttttgtatttttagtagagaagggggtttcaccatgttagccagatggtctcaatctcatgacctcgtgatccgtccacctcagcctcccaaagtgctgggattacaggcatgagccaccacacccagccagaaaaataggtattaaaggactaagaattgggagtacccagaacatctaattagacagtgtccaagggggttcaacataattatttgcttggttggtgagtttttggcctctatccttgaatttttttatgttgtcatatacctgtccagattgatttaggtaaaaacaacactcttcgtttaaaaatatacagagtcctcttttttttagcagtgagtaagtcgatgcctcggcaattttggaggaaagagaaatgcaaagccagcaattgttcatttaagaaggattagaaatggctaagagagagtttgatagtgtggtggagatagctggggagaggtagagggtagcataagaacggaaccagaataagagtgagtataaaagtaaagaataggacttcatcagggtgaaagtactggagggtaccttgccactgaagatcttctatcgacttcaagagcgacttaagggtggtgatttgaagtaaaaccaggagcctccaaataccaagagcctgagaaccttcttgggtgatttgactaataaaggccggtgcgttatcagactgtatagaggtgggaaggacaaacccaggaattctgtctaaaagaaaggaagaaatgatcacggtggacttctcagaccctgtgggaaaggcctctacccatccagtgaaagtgtctacacagaccaagaggtattttagtttcctgactcagggcatgtgagtagtcaatttgccagtcctgggcagggccaaatcccagagcttgatgtgtagggaagggagggggcctgaacaatccctgaggagtaatagaatagcagatggaacactgagaagtgatttccttgaggatagatttccacaatggaaaggaaatgagaggttctaagaggcaggctagtggcatgtaacctacatggaagaggttatgaaaggacgacagaatagactgggcctgtgaggctggaaggagatatttttcttggtccaagaaccatttgccttgtgtgggaagagattgataggtggaagtttcggtgggggagtaggtgggagtgactgatgagaaggagaaaaaccggccatgagggacagaagttggaatgctagctgcttctttagcattgccctgagcgatgggatccgatgccttttgatggcccttgcagtgaatgactccagcttcctttggaagtaaagcagctttaagaagactttttattaaggaggcattgatgatggaggacccttgcgtagtgaggaaacctctttctgcccatataacagcatggtggtacaggatatggaaggcatatttagagtcagtataaatattgatgtgtagtccctttgcaagagtgagggcctgagttaaggcaatgagtttggcttgctgagaagtagtggagtggggcagagtggtagcctcaaggataaatatggaagatactatagcatagcctgcctttgctggtgagtggcaattaggcctgatggaactgccatcaataaaccaagtgtgatcagggtgaggaacaggaaagaaggaaatatggggaaatggagtgaatgccaggtgtatcagagagatacagtcatgggtgtcaagtgtggtatcaggaataatgtgggaggccagattgaagtctgggccaggaacaatggtaattttgggagactcaacaaagagtgagtatagctgaaggagccggagagcagaaagtatatgcatcaggtgtgaggaagaaaatagattttggaagttataagaactgtagagagtgagttgagcacagtttgtgatttcaagggcctctaaaagtattaaggcagtggcagctgctgcacagagacatgatggccagcctaaaacagtaaggtcaagttgtttggacaaaaaggctacagggcacagtagccttgtgtaggaatcctggtccttgtgtaaaaattccgactgcacagccctgtactttggctgtgtgtaatgaaaagggttgggatgagtcagggagagctagtgtgggagcagtctctaaagctgtcttcaaggaacggaaagaggagtagggaaaggatttaggatctatggggtcagctaggtttccctttatgagtttacattaggttttgttagtacggcaaaaccaggtatccaaagatgaaagtatccaaccatgcccaggaaggaaagaagttgtttttttgtagaaggggttggagtttgagagattagccagacatgattggcagggagaacatgcatgttttcatgaagaattatgctgaggtaggtaacggatggggaagaaatttgagctttggaggggggatacctgatatcctctggagaataaatgttgaaggagcaggagggtatcttactgagaagactcaaaggagggactacaaagtaaaaggtcatccatgtattgaataaggtgggaagcagaggggtggaaagaaagtaaatcacgagaaagggcttggctgaagtaatgagggctgtccctgaagccttgtggcactatagcccaggtaagctgctgggactgacgtgtgtcagggtcagtccaggtaaaagcaaagagaggctgggatgaagggtgcaaaggaatagtaaagaaaccatgtttgagatccaggacagaataatgggttgtggagggaggtattgaggataggagagtatatggatttggcaccatagggtggataggcaagacaatgtggttgataaggcacagatcctgaactaacctataaggcttgtccagtttttgcacaggtaaaaggggggaattgtaaggagagtttataggctttaaaaggccatgctgtaacgggtgagtgataacaggctttaatccttttaaagtgtgctgtgggataggatattggcattgagcagggtaagggtgattaggttttaatgggatggtaaggggtgcatgatcagtcactaaggagggagtagaggtgtcccatacttgtggattaaggtaggaagacacaaggggaggacgtgaaggaggctctgaactggggaaaagggcggcaatgaggtgtggctgtagcccaggagtagtcagggaagaagaaaatttggttaaagtgtcctgacctaataagggagctgggcaggtggggataaataaaaaaagagtgcataaaagaatgttgtccaagttggcgccagagttggggagttaagaatgttgtcccagttggcgccagagttggggagttttaagaggtttagaagcctggctgtcaatacccacaacagttatggaggcaagggaaacaggcctttgaaaagaaggtaatgtggagtgggtagcctccgtattgatcaagaaggggacagacttaccctccactgtaagagttactcaaagcgtccgtgatggtccaggaggcttctgaggcaatcggacagcgtcagtcttcagccactaagccgagaagatccgggaaggagtcagtcagagaaccttgagccagagttcgaggggctctgggactgtctgctgggcgagttggacagtccgatttccagtggggtcctgcacaggtggggcatggcttaggaggaatcctgggctgtgggcattccttgccccagtggccagatttctggcacttgaagcaagatcctggggaaggcagtcctggaggaatgcctgacccttgcagtttaggcgttctgaagttcttgtgtgctggagatgtggctggggtttctctcacagaagaggcaagtaatcgcaactcttctctattattgtacaccttgaaggtgaggttaattaagtcctgttgtggggttgagggccagaatccaatttttggagctttttctaatgtcaggagcggattgggtaataaaatgcatattgagaatatgacggccttctggcccctctgggtctagggcggtaaagcatctaagggttgttgccaaacgggccatggactgagcggggttttcatatttgatgaaaaagagcctaaacactaactgatttgggagaggttgggtaaagaaaaaggagcattaaccttggctatgccttcagctccagccacctctctaagaggaaactgttgggcaggtgggggagggctagacgcagaacaaaactgtaagccagacccggtgtgaggaggggaagtgatagaaggattatagggtgggggagcagaggctggcgaagagttgggacctggctcagcctggcgaggagcagcctgaggagaagaggagaggtcagatgagtctgtggaaaaggaggattcaaaggactcagagcttggggtggagactgaaggaacagacaggagagaaagaagaaagttttgggatgagtctcatcaggagcagagattaggaagggactgaagtgtaaaagaatgcctggacatcagatacctcagaccatttgtccattttatgacaagaattatctagatcttgtgggatggagaaattgaaagtgccattttctggctatttggaatcattgtcgagtttgtactggggccaagcggtgttgcagaagaaaataagacgcttaggtttcagttcaggtctgagttgaagaggttttaagtctttgagaacacaggctaagggagaagaaggaggaatggagggtggaaggttgcccatagtgaaggaggcaagcccagagaacagagagggtagagacacggagaagagggggtagtgagcagccctgggctgcaatgtgggtgagcagccaaagcaggcatccccacaattgactgaccaccaagggaatgtgggtgaataatcaggcaggcgtccccgtggagatcagacaccaatggagtgtgggtgaataatcaggcaggcgtccccgcggtgattaaacaccaaggaaaggctgtcttcccgagtccgtgactggcgccggagttttgggtccatggataaaatgtgtctccttgtctctactagagaagaaaaagaactggaattggaaggacaggaagattgaagggtagcgagagaggaaggctggagggtagtgagagaggctggagaagagcgaaaagaccacttacctgatttgaaattggtgagatgttcctttggctggttggtctgaggacccgagttgtaggtggatctcctcacccagtgaaggtgaggacaggggaccggtctcccgaaggagtcctcccgtcccgagttttggcaccaaacgtcacgcacgtctgtgtgaagagaccaccaacaggctttgtgtgagcaacaaggctgtttatttcatctgggtgtgggcgggctgagtccgaaaaaggactcagcaaatggtggtgggatcatcattagttcttataggtttgggataggcgtacaaagtacagtctcaagagtggggacaatattacaaagtacattctcaagactggggagaatattacaaagtaccttcttaagggcgggggagaatatatcatatcagttagggtggggcaggaaaaaatcacaatggtggaatgtcatcagttaaggttattttcacttattttgtggatcttcagttgcttcaggccaggtggatgtatatgtgcaggtcacaggggatatgatggcttagcttcagctcagaggcctgacagtcaggagttcaaaacaagcctggtcaacatggtgaaaccccgtctctactaaaaatacaaaaaaattagccaggcgtggtagtggatgcctgtaatctcagctacttgggaggctgaggcaggagaatcgctggaccttgggaagcagaggttgcagtgagccgagatcatgccattgcactccaacctggaagacagagtgagactgcatctcaaaataaaaataaaaataaattaatcatctgttggctgggtgtggtggctcacacctgtaatctcagcactttgggaggccaaggtaggcggatcacctgaggtcaggaattcaagaccagcctggccaacatggcaaaaccccgtctctactaaaaatacaaaaagtagctgggcatggtggcgggcacatgtaatcccagctactcgggaggctgaggcttgaatcgcttgaaccagggaggtagaggttgcagtgagccgagatggtgccactgcactccagcttgggcaacggagtgagactccgtctctaaaaaaattaattaatgaattaattaatcatctgttgaaaaggacctgtctccaaatacaaccacacattgaggtagaggggttagggcttcaatatattgatttttgggagaaacagggcaacatggcaacaagccacagtcactgtgggcgggcctgagtggggagtgcaggggttcctgtcctgtgtgtctgtctcacaggggagtcccgacctgaccctcacagcccctccacccagaccttcctgcatgttccacccagcccaccctcctgcacccaagagcacccagccctccctcctgctcatgcccctcccttctcaaatccctcccagcagtgcagctctgggctaggacacagcctagggaacgtgactgagaaagagccaagaaaacttgatcagtgatcaagttggtgtttaagtaagattttcaataaaaagtagaattgggtactacatggaggcctgagatgttcagagctttttgagaaagcagaacagaaagtagaagggcaaccaggaaccagaggtgccagagaaccggaagcgcgggccctccgaggagacagggagtgggcacctgggtcttgggcctgtcgacaaacagagtcaaactctgtaaaatatttgaagagacgtattctgagccaaatacgagtgaccatggcccgtaacacagggctcaggaggtcctgataacatgtgcccaaggtggtgggggtgcaacttggttttatatattttagagaggcaagagctatcaatcaaatacatttgagaaatacaggagctgggtacagtggctcatgcctgtaatcccagtgctttgggaggctgaggtgggtggatcatgaggtcaggagttcgagaccagcctggccaacacagtgaaaccctgtctctactaaaaatacaaaaaattagccggtgtgatgatgtgcacctgtaatcccagctactcaggaggctgaggcaggagaatcacgtgatcctgggagacggaggttgcagtgagccgagatcacgcaagggcactccagccagggcgacggtgtaagactccatctcaaaaaaaaaagaaagaaatacattggtggctggacacagcagctcacgcctgtaatcatagcactttgggaggccgagccaggtggatcacgtggggtcaagagtttgagaccagcctggccaacatggcaaaaccctgtctccactgaaaatacaaaaattagctgagtgtggtggtgggcgcctataaccccagctacttgggagactgaggcaggacaattgcgtgaacccaggaggcagaggttgcagtgagccaagagcatgcaactgcattccagccttggagacagagcaagactctgtatcaaaagaaaagaaaagaaatacattggtttggttcagaaaggtcggatgactcaaagtaaggggagggggtttggggggcttccagggtacaggtaaatttaaatattttgtgggccaggcacagtggctcacacctgtagttgcagcactttcggaggctgaggcaggcggatcacgaggtcaggagatagagaccatcctgactaacacggtgaaaccccatctctactaaaaacacaaaaaattagctgggcgtggtggcggtcgcctgtaagcccagctgctcgggaggctgaggcaggagaatggcgtgaacccagaaggcagagcttgcagcgagccgagatcgcaccactgcagtccagactgggtgacagagcaagactccatctcaaaaacaaacaaacaaaaaacattttctggttgacgattggttgagtttgtctagagacctggcatccatagaaaggaaacgttcaggttaatataaaagattgtggagaccaaggttctttcgaagtctcatagtggctgcccttagagacaatagatgacaaatgtttcccattcaggtctttaaaaggtgcaattagttaatatgtttaggactgggaaggtctggaagaaaaagatccagctatattaatagagattctttacagatgcaaattttcccccacaaaggacaactttgcagggccatttcaagatatgtcaaagaaacatgatttggggtaaaatgttttgtcttctttgtcacgtaattttgtgcctgagtcagactggaaaatatctcacaatatatagggttaaataaaacccatctgggccgggtgcagtggctcatgtctgtaatcccagcactttgggaggcctaggtgcgtggatcacctgaggtcaggagttcgagaccggcctggccaacatggtgaaaccccatctctactaaaaatacaaaaattagctgggcgtggtggcgggtgcctgtaatctcagctacttgggaggctgaggaaggagaatcgcttgaaccagtgaggcagaggttgcagtgagccaagactgcaccattgtactctaggctgggcaagaagagtgaaactcagtcttaattaaaataaaatgaaataaaataaaataaaaatagaagccatctgatgaggatatatgcttggtagggcatgactccccagacctcttagatagtgtcacacacgtccgtgtgaagagagtccacagtaggctttgtatgagcaacaaagttatttatttcacttgggtgcaagtgggctgagtccggaaagagagtcagcaaagggagataggggtggggcagttttataggatgttggtgggcagtggaaaattacagtcaaagggggtttttctcttgtgggcaggggcagggcttacaaggtgcttggtgggggaacttctgagactcattgtccaggagaaataacttcacaaggtaatgtcatcagttaaggcaggaaccggcaatttttacttcttttgtggtttttcagttgcctcaggccatctggatgtatttgtgcaggcttgggctcagaggcctgacattcctgtcttcttatattaataagaaaaataaaacaaaatagcggtgaagtgttggggcagtgaaagtttttgggggtggtatggagagataatgggtgatgtttctcagggctggtttgagtgggattaggggcatcatgggagagattaaactgaagaaagattttggggtaaagggtgataaaccaagtgtgatcagggtgaggaacaggaaagaaggaaatatgaggaaatggagtgaatgccaggtggatcagagagatacagtcatgggggtcagatgtggtatcaggaataatgtgggaggccggatttaagtctgggccaggaacaatgataattgtgggagactcaacaaagagtgagaacaactgaaggagctggaggtcagaaagtatatgtgtcaagtgtgaagagaaaaatagattttgaaatttatgggaactgtagagagtaagtggagcatgagcatagcttttgattttgaaggcctctaaaagtataaagcagcggcagccactgcacagagacatgtgggctagcccagaacagtaaggtcgagttgtttggacagaaaggctacagggtgctgtcccggctcttgtgtaaattccgaccgcacagtcttgtacttcggctgtgtgtaatggaaagggttgggttgagttaagaagcgctagtgtgggagcagcttctagggctgtttttaaggcatggaaagaggagtggggaagaatttaggatctatggggtcacctaggtttccttttgtgagtttatgtaatggtttagccaggatggcaaaaccaggtatccaaaggcaaaagtacttaaccatgcgtaggaaggaaaggagttgttgctttgtagaaggggctagggtttgggagatttgccagacacaatcagcagggagatcacgcgtgttttcatgaagaattacagtgaggtaggtaacggatggagacaaaatttgagctttggagggggatacccgatatcctttggagaataaatgttaaaggagcaggagggtgtcttgttgagaagattcaaaggaggggctataaagtagaagatcatcaaaatattgaataatgtgagaagtagatggacggaaagaaagtaaatcatgagaaagaacctggctgaagtaatgagggctgtccctgaagtcttgtggcaggacagcccaggtaagctgctgggactgatggtgtcaaggtcagtccaggtaaaagcaaagagaggctggtatgaggggtgcaggggaacagtgaaaaaagcatctttaagatcaagaacggaatagtgagttgtggaggaaggtattgaggacaaagagtgtacgggttgggcaccaccgggtggataggcaaaacaatttggttgataaggcacagatcctgaactaacctgtaatacttgtccagtttttggacaggtaggacaggagagttgtaaggagagtttgtaggctttaaaaagccatattgtaacaggctggtgataagaggctttaacctttttaaagcctgctgtgggttgggatattggcattgagcaggataagagtgataggggtgggacagttttataggatttgggtgagtagtggaaaattacagtcaaaggggatttttctcttgcgggcaggggtgggggttacaaggtgcttggtgggggagcttctgagactcattgtccaggagaacggatttcacaaagtaatgtcatcagttcaggcaggaaccggccattttcacttcttttgtggttcttcagtgcctcaggccatctggatgtatactcgcaggctgggctcagaggactgacaggtaggaatttgggaaagataaaaaaaaaaaatcagagcttagtcctcacgcctataactaaaaatagaatcgttagcccccacttaccaactttggcccctagtggccaaaggtatctcagaaaaaccttaaaactgagttcctggccatgatgggaggggaggtcaggcacgcctcattatcacccctcccttttgcagtttagacacaactgaccagcagtaatgttaaaacagaatcataagaccggcagaaccagaacagactcttcatggcaatcagataccaaatcacaaccaggacctcaggccgtgccaggcaagggtgaggtcacacaccctacacttcaacagtcaactctgttctgcctgccacaaggtttttcttttgcttgtttagcagctaaacaagaactgcctcgagataaagaagatgaaaacaatcgcagctcatccagcgcgctgacacggagcaacagagcccctgctccacagccctaactccagctttccctgggcaagagactgatttcagtaacttcctccagatcagaagaccactgacaacagactggttctgcatggtttacagacctggcaaatttcggtgccttcatgtcctgaaaagaccctttgacatacaggcttaattgtagtacatttaaatattgtcctttaggaggccgaggtgggtggatcacgaggtcaggagatcgagaccatcctggccaacatggtgaaaccccgtctctactaaaaaggcaaacattagcagggcgtggtggcgcacacctgtaatcgcagctactcaggaggctgaggcaggagaatcacttgaacccagaatacagacgttgcagtgagccgagatctctccactgcactccagcctggtgacagagtgagaccccatctcaaaaaaaaaaaaaattcctcatgagagagttaaagttcgtcttattctcacactgagattttggaatgagctgtgtattttacacgtgccaaagtctctaatcagagccctatttcaggtgctcagtagcttctgtggtcaaccttcaactccacgggacaatgctgttccaatggcctccccagcagaagacaggcagggaacaaggctgaccccagagggccaggccacagcaggggctgaggatgcctggtgaatggatgcctgggagaaaggatgccagaattcgtgctcgaggacatgatgaaacagggaaagactcaatagaataaagaaggaaggggacgggtgcggtggctcacgcctgtaattccagcactttgggaggctgaggcgggcggatcacgaggtcgggagttcgagaccagcctggccaatacggtgaaaccctgtcgctactaaaaatacaacatttagatgggcatggtgtcacgagcctgtagtcccacctacttgggaagctgaggtaggaaaatcccttgaacctgggagacagaggttgcagtgagacgagattgtgccattgcactcgagcctggctacagagtgagactctgtctcagaaaaaaataaaaattaaaaataaagaaggaaggagaaggatggaagcgaatctcaatgaacaaaatgcactgggacctactatgtacccagaaaaatgaaaagtaaataaataaaataaggacttgcatggtggtttatgctcatagtcctagaactctggaactctggaaggctgaggcaggaggatcgcttgagcccaagagtttgagatcagcctaggcaacatgcgaaacccatctatacaaaaagatatgaaaacatacaaaaaaaattagccaggtgtggtggcacgcgcctgcagtcccagctaatcaggaggctgaggtaggaagatcccttgagcctgggaggtcaaggctgcagtgagcccagatcgcaccactgcaccccagcctgggcaacagagagagaccctgtctcaaaaataaataaataaggaaatgccctggggctccaggcccactctctgctcccatcgccccactcccgcactcctcctgctcctagtctgagctccccctgccttcctcctcctccttcccaggtcaatcctgagacccatagtcatgcagaaaggtgcttcctctcttggttctgcgacaacacactgtctcctaacaaaaactaccaggtcacctggtacacatcttggagcccttgcccagagtgtgcaggggaggtggcaagttcctggccaggcacagcaacgtgaagctcaccatctttgccgcccgcctctactacttccagtgtccatattaccagcaggggctccacaggctgagtcaggaaggggcctccatggagttcgtgggctacaaaggtgagacgtggggggctgaggtgactgggtgcaggagggacagcatggggggcagatgggtctcctgatatggtgaacaccacccggactgcgtgtatgtcccaaattacaattctttctttgcgaatgacatgtgaaatttagaggctcttctccacactttaaatttgactcaatattttcaaggcagatgtaagttattagagaatgagactctctataaaaatgaccccttcatgctgtggcctccacagaagatgccccgagtcacgtgcccacatggcaggcatttattttctcacagatctggaggctgcaagtacacgttcgcggggtgggttgggttgtttgctctgaggccgctcctcctggctggcagagagtctcttctggctgtgtcctctgtggcctttcctctttgcacctgcacctctgggatctctctgcctccaaatatcaacttttttttttttttgagacagagttttgctcttgctgtccaggctggagtgcagtggcacaatctcagctcactgctacctctgccttccgagttcaagcgattctcctgcctcagcctccccagtagttgggactacaggcatgcgccaccacgcccggctaattttgtagttttagtagagatggggtttctccatgttgctcaggctggtcttgaacttgtgagctcaggtgatccaccctcctcggcctcccaaagtgctgggattacaggtatgagccattgtatccaggctttttttttttttttttttttgagaggaggtttcactctgttgcccaggctgaagtgcagcggtagaatcactgctcactgcaacctctgcctcctaggttcaagcaattctcctgcctcatcctcctgagtagctgggattacaggtgcccagaaccactctactaatttttgtgttttttagtagagatggggtttcaccgtgttggccaggctggtctcgaattcctgactgcccacctcggcctcccaaagtgctgggattaaaggcatgagccagggcacttggccacccttctccttgatggacccccgccaagcgaatttgtgcccacactagaggtctcgtttaaagtaatcatctcggccgggcgtggtggttcacgcctgtaatcctagcactttgagaggctgaggccagcagatcacttgaggtcaggagttggaaacaagcctggtcaacatggtgaaaccccgtctctactaaaaatataaaaaaattatccgggcgtggtagtggacgcctgtaatctcagctactccggaggctgaggcaggcgaatcgctggaacccgggaggcagaggttgcagtgagctgagatcgtgccattgcactccagcctggaagacagagtgacgctgcatctcaaaaagtaaataaataaaaaataaaaagaaattaattatccgttggctgggtgcggtggctcacgcctgcaatcccagcactttgggaggccaaggcgggtggatcacctgaggtcaggaattcaagaccagcctggccaacacggcaaaaccccatctctactaaaaatacaaaaattagccgggcgtggtggcaggtgcctgtaatcccagctactcgggaggctgaggcttgaatcgcttgaaccagggaggcagaggttgcagtgagccgagatggtgccactgcactccagcttgggcaacggagtgagactccgtctctaaaaatattaattaatgaattaattaatcatctgttgaaaaggacctgtctccaaatacaaccacacattgaggtagaggggttagggcttcaatatattgatttttgggagaaacagggcaacatggcaacaagccacagtcactgtgggcgggcctgagtggggagtgcaggggttcctgtcctatgtgtctgtctcccaggggagtcccgacctgaccctcacagcccctccactcagaccttcctgcgtgctccacccacctcattcctcctacacccaacagcacccagccctcctgcctcctcatgcccctcccttctgaaatccctcccagcagtgcagctctgggctaggacacagcctagggaacgtgactgagaaagagccaagaaaacactcagtgatgaagttggtgtttaagtaagattttcagtgaaaagtagaattgggtactacatggaggcttgagatgttcagagctttttgagaaagcagaacagaaagtagaagggcaaccaggaaccagaggtgccagagaaccggaagcgcgggccctccgaggagacagggagtgggcacctggatcttgggcctgtcaacgaagagtcaaactcagtaaaatatttgaagagatgtattctcagccaaatacgagtgaccacggcctgtgacacagccctcaggaggtcctgagaacatgtgcccaaggtggtgggggtgcagcttggttttatacattttagaggggcatgggccatcaatcaaatacatttaagaaatacaggagctgggcgcggtggctcacacctgtaatcccagcactttgggaggctgaggcaggtggatcacgcgttcaggaattcaagaccacccttgccaacatagtgaaaccccgtctctactaaaaatacaaaaaattacccgggtgtggtggtgtgcacctgtaatcccagctactcgggagattgaggcagaagaattgcatgaacccaggaggcagaggttgcagtgagccaagaccacaccactgcactccagcctgtgggacagagcaagactctgttccaaaaaaaaaaaaaaaaaaagaaaagaaaaggccaggcgtggtgtctcatgcctgtaatcccagcactttgggaggccaaggcgggcggatcacgaggtcaggagatggagcccagtctggccaacatagtgaaaccgcgtctctactaaaaatacacaaaaagttagccgggcgtggtggtgtgcacctgtaaactcagctagtcagggggctgaggcaggagaatcgcgtgaacccgggaggcagaggttgcagtgagccaagattgccccactgcactccagcctgggcgacagagcaagacacaatctcaaaaaaaaaaaaaaaaagaaaagaaaagaaaaagaaaaagaaaaaagaaaaaaagaaacaaaaaaagtaaagaaaagaaatacattggtttagtcctgaaaggtcagacgactcaaagtgagggaagcggggttggggggcttccaggctacaggtaaatttaaacattttctggttgaggatgggttgagtttgtctagagacctggcatccatagaaaggaaatgttcaagttaagataaaagactgtggagaccaaggttattttgaagtctcataatggctgcctttagagataatagatgacaaatgtttgctattcaggtctttaaaaggtccaattagttaatctgtttaggactgggaaggcctagaagaaaaagatccagctatgttaatagaggttctttacagatgcaaattttcccccaccggggacaactttgcagggccatttcagatatggcaaagaaacatgttttggggtaaaatattttatctttcttctttgtcacataatgttgtgtctgagtcagattggaaagtaactcacaatatatagggttaaataaaacccatttgtgccaggcgcagtggctcatgtctgtaatcccagcactttgggaggccgaggcgggtggatcatctgcagtcgggagttcgagaccagcctggccaacatggtgaaaccccatctctactaaaaatacaaaaattagccaggcatggtggcggggacctataatcccagctacttgggaggctgagacaggagaatcgcttgaacccgagaggcggaggttgcagtgagccgagaccgcaccattgcagtccagtccgggcaagaagagtgaaactcggcctccattaaaatacaataagataaaaaaataaaaaatagaacccctctgatgaggatgtatgggttgtaaggcatgactccccagaccccttagataggattttgggcaagattaaataaaacaaatcagagcttagtccaaaggcctatgaactaaaaataaagtctttagcccccaccgatcccccccaactttggcccccagtggccaggggtatctcagaaaaaccttaaaactgagttcccagccatgatgggaggggaggtcaggcacgcctcattatcaccccacccttttgcagtttagacacaactgaccagcagtaatgttaaaacagaatcataagacgggcagaaccagaacagactcttcatggcaatcagataccaaatcacaaccaggacctcaggccgtgccaggcaagggtgagatcacacaccccacacttaaacagtcaactctgttctgcctgccacaagatttttcttttgctctagcagctaaacaagcactgcctccagataaagatgaaaacaatcccacctcacccagcgcccggacacggagtaacagagcccctgctccacagccctaattcctactttccctgagcaagagactgatttctgtaactttctccagatcagaagaccacagaccatggactagttctgaatggtttacagacctggcaaattttggtgccttcatgtcctgaaaggaccttttgacatacaggcttaattgtggtacatttaaatgttgtctccaccgcaatgtgaggacggataatacagctgcttttttttttttttttttttaatagattgttgtttgtttgttttttgttttgagatggagtctcactctgtctcccaggctggagggcagtggtgcgatctcggcccagtgcaacctctgcctcccgggttcaactgattctcctgcctcagcctcccaagtagctgggatttcaggcacatggcaccacgtccggccaactttggtagttttagtagagacgaggtctcaccatgttggccaggttggtctcgaactcctgactgtcatacatgtccatatagaagaccacctaaacaggctttgtgtaagcaataatgccatttattcacttgggtgcaactgggctgagtctgaaaagagagtcagcgaagggagataggagaggggcagctttataggacttgggtaggcggtggaaagttacagtcaaaggcggtcatctgttgtcagcaggggagggggtcacaaggtgcatggtgggagaccatgagacccattgtccagaagaagaatgtcataaggtcgattgatcagttagggtagggcaggaacaagtcctaatggtggaatgtcttaaggttggttaatcagttaagggagaaactggctgtttcacttcttttgtgtttttttggctgttccagacttcttggctgctgcaggccatctggatgtatatgtgcagttcacaggggtcacaatggcttagctctggctcagcggcctgacactgacctcagatgatccacctgcctcggcctcccaaaatgctgggattacaggtgtgagccactgtgcccgcctgggatcatatgttacacgcatgtttgttcaataagcatggagtgcagccacccacatgaatattcatagctcctcctgtagcctgttcaatatgtatgtttagctaaccccttcagcataaagctcctgccccaacccctcctgcttctaaatgtctgtctctggtgttaaccagaggctgctcttcccaggctgctggatggctaccttgcaggctgtcacccttaacaagaaataaagtgtcatttgcaaatgcatcccttgtgtaatttgtaggtcaccacgccatgggaacacgctaccaggggaagggagctgtgagacgcgcagggaggctccagacaggctggcctgggacaccagccgctgcccttccataacatggggacaagagagggcaaaagttcagcccaccacggaggatctccgggcaggagatggggaagaaggagaagcaggaaggaaagagctcagtgtgggggcgcgcatggcatcccggtgggacatctgaggcccacacccacctgctgtccctccctcccacggtggcctccgagggtgacggcctggggggaggcagacgcctggccatttactctccctccctgtccccatggccgctgggtgggggccgtctctgggatgatccccgagggcaggatccgggagtccctgcggaggcatcagcctgtctgtcttgatggtggagaggaggctccagctgggcgggaccaccaggggaggggcttgtgctctgctggctcagcctggtgtggacccacctcccgggcgctggctgcaatgactttctctttccctttgcaattgccttgggtcctgccgcacagagcggcctgtctttatcagaggtccctctgccagggggagggccccagagaaaaccagaaagagggtgagagactgaggaagataaagcgtcccagggcctcctacaccagcgcctgagcaggaagcgggaggggccatgactacgaggccctgggaggtcactttagggagggctgtcctaaaaccagaagcttggagcagaaagtgaaaccctggtgctccagacaaagatcttagtcgggactagccggccaaggatgaagcctcacttcaggtaccgctgcccgctctacccactgggcccctctgctgccccttcttgcctggtggctctgctgggcgtcagccctggccttcccctgccccagccccagccctgggctccctcccctctgactcccctgcaccccctactcccagccaggctccttgccctgctgtgttgtcgccccactgctgcttctgaatgggccgcctcccccatctgtcccagcccaggtcccctgctgagactctcccctgaaagtcatggctggggtggtgctcccggccctgggagggtgctccctctgtgtgcttcccgccattcctgaactctggaactgggagaattgaaccaaaggatgagtagagcaaggtggaattttgttcacagggctttgatggattttctgtaagatttactttgcttaaataccaagtcttaggagagggtgtggggagggaatggtctctgaagcacaggataaatcatgtcttccaaggatgtctccactgtgggcagaggaggatgcagatgaccccaaacacacgctcctcctccactatcagcattcactgtttataaatgacaccagtaacatggaatatagtggccgggtgcggtggctcacacctgtcatcccagcactttgggaggctgaggtgggcggatcgcctgcggtcaggagttcaagaccagcctgaccagcatggataaaccctgtctctactaaaaatgcaaaattagctgggtgtggtggcgggcgcctgtaatcgcagctacttgggagtctgagacaggagaatccattgaacccaggaggcggagtttgcagtgagctgaggtcgccccattgcactccagcctgggcaacaagagcaaaacttcgtcttgaaagaaaaaaaaacaaaaacaaaagaaaaaacatggaatatatgggaaaaaaactcaatgatcaggaggaatgttgttattttaaaatttagtaagaagagagcccggtccccaatggctgcctcctgcagggccagtgatacagagactggacagggctggcctggaaaggggcccccactccatttgtccccagctctgtggcctgggcaggttaccccgcctctctgcgcgtctggcccctcctctgtaagacgggaatggcccctgccagcctagggcagcctcacatgagctcacccccgcgcagcacttagaagactggcctgggcctcagaattcggttctaccatgatttaacaataataatatacagaggtgaaatgtcaggaaggaactgagctgaaaggttaaaagctgttattttggggtgaagagttttattctgtctctctctctctttttttttgagacggaatttcgctcttgtcgcccaggctggagtgtagtggcgcgatcttggctcactacagtctccgccgaaattctcaggggaggggagggatgggggaggcctagagccgtccagggggctgtgtttagtggacatcagcccggagggcccccaggagtgctctctacattggctggtttctctcttgtgtcttcagaaacacagtggagcgaatgtatcgagacacattctcctacaacttttataatagacccatcctttctcgtcggaataccgtctggctgtgctacgaagtgaaaacaaagggtccctcaaggccccctttggacgcaaagatctttcgaggccaggtaccacccggactccaatcactttgcaggcaggagctaagccagctgggaaagcaaaccacgcactgataagtgaagtgcccggcggcgggctatccagtgtgtccttctctcccacactttccaagtccgtggccctgaccttcctgctggaccgtcctgggatcggatcgtggagggggtttgcctctgcacaaaaggccttgtgtttccgtttttcttttcttttcttttttcttttttttttttgagacagagtttcactcttgttgctcaggctggagtgcaatgacgcgatctcggctcacagcaacctctgcctcctgggttcaagcgatgctgtcgcctcagactcgcaagtagctgcgattacaggtgcccaccaccacgcccagctgattttttttttgtatttttagtacagatggggtttcaccatattcaccaggctggtctcgaacttctgacctcaggtgatccacctgcctcggcctcccaaagtgttgggattacaggtgtgagccacagcgccggcctaattttaatatttaattaatccaatgtggctaacatattacttcaacattaattaacataaaattcttgacaagataatgaagtttctttttcttgtcacaccgagtctttgaaatgagctgcgtgggtcacgtacagtgggtggctcgcacctctaatcccagcactttgggaggccaaggcgggcagatcacctgaagttagatattcaaaaccggcctgggcaacatggtgaaatcccatctctactaaaaatacaaaaaaaaaaaaaattagccaggcatggtggcagtcacctgtaatcccagctactcgggaggctgaggcaggagaaccgcttgatcccatgaggcagaggttgtagtgagccaagattgcatccttgcattccagcctgggcaacaagagcgaaactccatctcaaaaaaaaaaaaagaaatgagtggtgtatttttcaggtgcccaggtctctaatcagagccccatttcaagtactcagtagtcccttggccatgtcaccccccccgacatggacagtgcaggtccagtgggctccccactgactgcaggcagggaacaaggcagaccctagagggccaggccacagtaggggctgaggatgtctggtgaatggatgcctgggagaatggatgctagaattcacacacgaggccatgaacagggctgggaaaacttccaaactcagggaagcacgtgtcttggtgcaccttgtgatgcttcaacagcaggactgagatggggacatttacaatgaacagaaatgtatgggctcgagttctggactctgggaagtcccctgtcaatgcaccagcaactttccagggcctgcgagctgcacagtcacgtgggggtgaaggttgttgccagaagctcaggggatgctccagacagagtggcctgggatgtcgagtcactgctgctccgtgacatgggggcaagaggaagcagtttagtctgacatactgcccccccagctagagggcaagagacagaaagaggggctgaagtcgcccttgaataaccacagcagtggcacccacaaaggtgcagttcccacagcctcatagctgcttgtaggtgccacctcttaaggccattaccatagcaattaatactgaacatgagctttggagcagacaaacactcaaaccgaacagggggatggaggaaaggagcttcaatggcaagatctcctggactcctgtcctggcccctcctccccctgccccacccctgctctcctcctgctccccctctcagagcttgccctgaccctgctcctctcccaggtgtattccgaacttaagtaccacccagagatgagattcttccactggttcagcaagtggaggaagctgcatcgtgaccaggagtatgaggtcacctggtacatatcctggagcccctgcacaaagtgtacaagggatatggccacgttcctggccgaggacccgaaggttaccctgaccatctttgttgcccgcctctactacttctgggacccagattaccaggaggcgcttcgcagcctgtgtcagaaaagagacggtccgcgtgccaccatgaagatcatgaattatgacggtgagaagtgggaggttcaggggtgtgggagagactgcttaagtgtctgtgatgggtccttcccacacatacctgtgggtctgctctgatgcctgcaaaggccaagtgtcccaggggagcctgtggggttgggtctggcgctgactgtaactagtatctagaatatgtctgggaggggagggtcccgaggtcacagaagagaggccagctgggcttgactgcgttctctcttctttttcttagaatttcagcactgttggagcaagttcgtgtacagccaaagagagctatttgagccttggaataatctgcctaaatattatatattactgcacatcatgctgggggagattctcaggtgagggtctccctccaggctcatcgcctcgctcctctcacctcctgctcatcctcttgaggcctcccctctgttccagaccaggtcctctcctggccaggccctcctgccttccctcctgccccctgcctgccctcgtggttacactccctcacccacactcctcgtgctccctccacctccctgcctcccacctgctttcctgggcccttcctgtgagtgagaggccccttctgcctccagagcaacctccatccacccccacagcctgggagccccaacctggccccttccatctccctggcataaccgaatttgtcgtaaaactggacgtagtaagtgggcatgaatagtcacaagcccggcagtcagaagctttgagcaacatccttaaaggccaacctgagcccctgagaaggagctgcctccatggaaacagagcttcaggcttcggctgccatagaagatggccgggctgggtgcccacagggcaggcatttattttctcacacatctggaggctgcaagtccaaggtggaggggtgggcggggttgtgtcttctgcagtcgctcctcctggctggcagggggtcccttccggccctgtcctctctggcctttcctctgtgcacctgcactcgtggggtctctctgcctccaaatgtcctcctcgtttatggaccccagtcatgtgaatttgggcccacactgaaggtctcatttaagttaatcatctgatgaaaggacctgtctccaggccaggtgcagaggctcatgcctgtaatcccagcactttgggagtccaaggcgggtggatcacctgaggtcaggagttcgacaccagcctggccaacatgttaaaaccccatctctaccaaaaatacaaaaattagccgggagtggtggtgggcgcctataattctagctactcggaaggctgaggcaggagaatcgcttgaacccgggaggcggaggttgcggtgagcccagactgcgccgctgcactccagcctgggcaaaaaagcgaaacttcttctcaaacaaacaaacaagaaagaaaggacctgtttccaaatacagccaccctttgagggagcgggggttaaggcttcaatacattgattttggggagaaacagtgaaggccacggcaagaagctgcagtcattgtgggcgggcctgggtggggagtgcaggggttcctgtcctgtgtgtctgtttcccaggggagtcctgacctgactctcacagcccctccacccagatgttcctgtgtgcttcacccaccccattccttctgcacccaacactcctgagcccctccttagctcccccgacaggctcccctgctcccccactcccgggctgctcctcttctcagcctctctctgggcctctctggggtccggacatgacccctcagctgatgcctgtggcttccccagccagaatcttcccagttccaggctgggctctgcagagtcctatcaaaggtggcatcctcccctctgtccactccagggtgaagatctggtgtttctggtttggaaatgcctctgcactgggtgctaataattcacttttacctttataattgtggttttgtaaggacaggtatttttggcaacagaagaaatcctgtgagttatttaaaaaaaaacaaaaaaactccctggcaggctcttctccccgctggtcccgctcaggagtgtctctgccctgatgctgggtgtggcaagagttaaccctgtaggcaggaggggtgccccagtgggtccacctccagcaaggactgagagcgagcagagccaggactggggtctatggtgaggccagggaagaagacccagctgtaccccagggagagggcctgagcacactgagctgaccctggggagaccctgacaaggcttagacaggccccagggctgccgtgatctcccagtgagccccagaaggggtcagagggggaggtttggaggctctagcaagtgagtgggagccccttctgacaggtgctaagggatgtggggagccgggggaaggaaggagggtggggtgcaagggaggaagcgtggagagggagggggaggtgggacagaccaggagggctcttactcctctgggcttttcccccactttccagacactcgatggatccacccacattcactttcaactttaacaatgaaccttgggtcagaggacggcatgagacttacctgtgttatgaggtggagcgcatgcacaatgacacctgggtcctgctgaaccagcgcaggggctttctatgcaaccaggtgaccaacccagccacccgcatccaggcagggccctcccaacccagggacacccatgggcagaaggttctgggtggtacctgtggtgtcctgcagagtgtctgtcacctgtgcttcctgtagctgctgctgcttggccctggggttgggggagacttcggcttcagtgactctccaggattggtggcttccagccccacacgcctaaccagccacatgtctcaggggctaacaccactagtccagagtcacccccaggtccaggtctcagccgtccccactcctgctgtgctctgagagggtcagggcagaggaaaagggtctgcaccagggccaagtgggatcaaagaaaaagcgcttccggccgggcacggtggctcatgcctgtaatcccagcactttgggaggccgaggctggcgatcacaaggtcaggagatcaagaccatcctggctaacacggtgaaaccccatctctattaaaaatacaaaaaattagccaggtgtggtggcaggcgcctgtagtcccagctattcaggagactgaggcaggagaatggcatgaacctgggaggcagagcttgcagtgagccaagatcgtgccactgcactccacctgggcaacagagcgagactccgtctcaagaaaaaaaaaaaaagtgcttcctgaggaccctcccaggatcccctcacagacacagctcccaccaggaatgattcagaactgtgggatttgaggatcagggcctacctgacctcacaaggccaggattccccagtgcctgctcctgggcttcatcctgcgggaaaagagactgaggcaggagaggccgaccagggattctgtcctgaccaggatggagcccacagcaaggccagaacaggccccaagtcaggatgcagggatggccagcatttgaagaagagctgggccaggccaggccgaggggccctgagcccgagggacgttcttccctcgcccttgcccagcacagcccctggctggagaggccaaattctgcttggctctggtgctggaaacggggttcctctgggctctatgagcttaatatgggccctgctgggcccacacacactgcttggaagctactttcaaaggcaccggtccccatcactgtctaaccagtgggatgggactcccccaggaatgacccacagccccttctcagcacaaatcgtgtcatccattctaccccgagtcctctctgcactggactcctgggcttgactagttcccagtcgaaatttggacaaaacaccatcattccttgggctcaacaaggacaatcaccccatgactggggcccttcccaatgtggggttagtcctgctgggggcccctcatccccacttctccctgcaaagggagccctctggcctcagtctatgtcactcgtgggcttaatacagggtaaagcacaatgtggaagctt

SEQ ID NO: 27 - DNA, 3186 bp, Homo sapiens
  modified_base (2083)..(2083): a, c, t, g, unknown or other
  modified_base (2098)..(2098): a, c, t, g, unknown or other
ggatccccggcatctgagacgtggggctcagcaagggagagatgccgggaggaagggccagagggtctgtctcaagcccaggcctgactggccccagtacccacggtgctcccaaaagcctcagcccagcccaggaccaccctcctcggaaccggccctgccctgccctgggcctgttgttgtctgttcatcagccacgttggcagcggcggcaggaggctgggcccagggctgacctccatctgtgccccggctcccactcaccttcagcctagccagggcaggggcaaagcaagtctgtgggcccctccacaccactcaggtgggtgctgcccagcacaggcgaacggcaaaacgtgctgggctgaacagtggatgggggccccaaagaggttgggttcttgcgcgaggcggtgggttgttcagagacccgttcttccagggaaagaaattccttcctgtgagtataaagagggtgaaggcggggactggcttccaactcaacgggcggcagaccaagaacctgctttgaggccctgggtgctggggcccagccccaaagagttcacgattttggggagactggagccgggacacctagagcaatagttacaaagtggccgggatggcgctgcccccaacgtagcaggaggggcctggagagtgggggaaggaatcccacggggagggcttctggggccctggagggcgggaggcagggctggtggagaccaggagggctcagtctctccctgcacaacgcagggtggagttgctgcctccacagcccgggccttctgcccacagggctccccaggcaacttcgagggccgggtcctcacagtcctcactctgtccagtgctcacctcactgctgccccagctgccctccctgcctcggagtggcctctgcctctgcctctgcctcacacaccccatcagcccacagccaccccgagcccttgcagctcaaggaccttctgcatccccggcagcaaccctgagcccagagccaggagagtaggaccagcacctgcccttcctacctcccctgccctggacacccacgggcacccacagggcaccgggcacaggctgcaactctattgagggaactatggggggaatgcagggacaaagacacaggatggtgatggatggtggggggtggggggcggggggtagcgggtggcaggtcagagacaaagtgacccaggaacggacggcagcgagagaacaagacccacagagacagagaagtgaaagtgggagagatggaggcacagcagcaggaacagcagggccaggaggccactgggccccgttgcggagggcagacctctgcctggcggggggcagcaggggcagcgcccagcgacagccaggctggtgggcgtgggccaggcagggtggggcaggtgcccgtcctgggctgacgcttgcacagagccctgcagaatgccgctggctggcggactgcccacccccgcccagcccgtgcctataaggccttggcaatgcaggggcccgcactgctcccagacgacatcagagatgaggacagcattgctgctccttgcaaccctggctgtggctacagggccaggtgaggggctgggccaaggggacgggcgggtgggcggwtctggcctgtgtggtcaccaaatactaggagcctggagctgacgacatctaggcacagagaaccccgacactgtgggtgctagactcttcaaatttaaaacaacatggagcccgaatcttaacgagtgtcagatttacaatgtttcagaatctgaggatcttagaactgactcctggagtcacggaccctgagagagtggagcagggggttgtcttgagatgcttctcactgggagagcggccatctagtccctgccaccagcccctcccggtccccaggtctcccccagcacagcccaggacagcccaaaggccaccaagcccttcctgtcataggctcagagcagccaagctggctgcccccggggccttagctccgtcaggccctcagaaacatagccatctcctccagggacatcccctggggtggggacaaganccagtgtcctcttgncagtcgcagagctccctgagaccttggaggaaaggcttgcaacacaccctagacaggggcagggcaggacacctcttccaagccggcccaggctggaatacatgtcccctgaggctgcactcagggcacatgccctgccaggacccagagcccgggtttgggggcctagggcaagggcagcagggcctctgtccaggaggggtctctgcaggtgggggagcaggccctgctaagtcaccaggaggcctctgttgggcccgctgagccggactccctccccgccagcccttaccctgcgctgccacgtgtgcaccagctccagcaactgcaagcattctgtggtctgcccggccagctctcgcttctgcaagaccacgaacacaggtgggtagcatctgtccaggtgtccctggggctggggacatccctggctgttgtgggtgttggctggaaggttgtggggaggtggggggcagaggtggctgcctggcctgaccacactcacctgtgcccagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccacagtgccctcagcctggggctggccctgagcctcctggccgtcatcttagcccccagcctgtgaccttccccccagggaaggcccctcatgcctttccttccctttctctggggattccacacctctcttccccagccggcaacgggggtgccaggagccccaggctgagggcttccccgaaagtctgggaccaggtccaggtgggcatggaatgctgatgacttggagcaggccccacagaccccacagaggatgaagccaccccacagaggatgcagcccccagctgcatggaaggtggaggacagaagccctgtggatccccggatttcacactccttctgttttgttgccgtttattttgtactcaaatctctacatggagataaatgatttaaacc

SEQ ID NO: 28 - DNA, 521 bp, Homo sapiens
  modified_base (52)..(52): a, c, t, g, unknown or other
  modified_base (140)..(140): a, c, t, g, unknown or other
  modified_base (233)..(234): a, c, t, g, unknown or other
  modified_base (340)..(340): a, c, t, g, unknown or other
  modified_base (353)..(353): a, c, t, g, unknown or other
  modified_base (363)..(363): a, c, t, g, unknown or other
  modified_base (367)..(367): a, c, t, g, unknown or other
  modified_base (441)..(441): a, c, t, g, unknown or other
  modified_base (521)..(521): a, c, t, g, unknown or other
gccattgtccaacgtcccccacaagtcctcactgcccgagggatccgcctgngcacggtgctgagaattcgcggcttggttcctcccaatgccagcaggttccatgtaaacctgctgtgcggggaggagcagggctcgantgccgcgctgcatttcaacccccggctggacacgtcggaggtggtcttcaacagcaaggagcaaggctcctggggccgcgaggagcgggccgnngcgttcctttccagcgcgggcagcccttcgaggtgctcatcatcgcgtcagacgacggcttcaaggccgtggttggggacgcccagtaccaccacttccgccaccngcctgccgcttgncgcgcgtgcnttgngttggaggtgggcggggacgtgcagcttggacttccgtgagattctttcttgaagcaagaagcccaaggcgggncccggggcctttggcttgggcaaataaagcgttaagcccgcaaaaaaaaaaaaaaaaaaaaaaagattgcggccgcaagn

SEQ ID NO: 29 - DNA, 624 bp, Homo sapiens
ggatccagatggcatgtcacagtatactaaatgctcactgaatccagctgcaatgcaggaagactcccctgatgtgatcatgtgtctcaccctttcaggctgaaagcaacagtacagacgatgagaccgacgatcccaggacgtatcagaaatatggttacattggaacacatgagtaccctcatttctctcatagacccagcacgctccaggcagcatccaccccacaggcagaagaggactggacctgcaccatcctctgaatgccagtgcatcttgggggaaagggctccagtgttatctggaccagttccttcattttcaggtgggactcttgatccagagaagacaaagctcctcagtgagctggtgtataatccaagacagaacccaagtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccatttattgggtg

SEQ ID NO: 30 - DNA, 1922 bp, Homo sapiens
gagacctgggcgttggtgaaggcgaggggaaagccagaatactggggtggcggacgccaaggggcgggtgtagcaggcaacctcagggaagctgggaaggcctagcagggtgagagaacccgcacacggggggcacagcgcctccctcgcgagccggtgcgaaaggggccgcctgcggtgtgcgcccagctgcgctcaagggaccttgcacttggcccatctcctgcgcacagcccaggccgggaccgcgggcggtgcggactcagcgggctgggtgcaagggcggggcggggcgtctgcgcccggccccgtctcctgactataaaagcagccgctggctgttgggctccactccgccttccacgtgcacccactgcctcttcccttctcgcttgggaactctagtctcgcctcgggttgcaatggaccccaactgctcctgtgccgctggtaagggacgcccgggttctgtgccttggaatgccaaattcccagacaccatagagagtgtccctgggtttgaggaggtcgtattttgctatcagaggtaaggggactcctttattggtccagtgctttcctgttggccaagctcctgagggcattttcctcctccctgttcctctatgtcagagttgagggtcctgaggctcaaggctgtcctgctcatgtcagagttgagggtcctgaggctcaaggctgtcctgcctcacgtcacctagttggtcacagggctgctggctgagccccaattctctaacctgactctgagctaccggattggataggagacattggataggagggacattgcctcttccaagttcaggacagaaagtcgaagtcttcctaggccgtgatctgcagggactttcctttggagtagaaataggagggtgcttggttttcccagcatgaatggagaggacatggggcttctcttcctcgtctctgagtgggaaaggagctctgacggctggctctggcacagagaagggggaagtggacactcattgacccactgctgtaccttctgcatctcactcaccgttcactggctttttctcttctagcaggtgtctcctgcacctgcgccagctcctgcaagtgcaaagagtgcaaatgcacctcctgcaagaagagtgagtgcggggccatctccaggaatctggggctgtggctaaggttgggagggaacccaaggctgtccctgagtgcctgcttctggggaaccggccttcctttgtccctgtaggttgtcacgcctgtctagtcttctgcactttccaaggcttatgtgaggtggggcagctttctcaaaggaagacccattccaatgtccaccagttgtctcctgacaaaaaccatgccatcatgaactaagggtcctctggggctggagggatggagacaggcctctgttggggcagggagttctatgatcgagtctgctctgacctctcaatctcctttcctccccaaggctgctgctcctgctgccctgtgggctgtgccaagtgtgcccaaggctgcatctgcaaaggggcatcggagaagtgcagctgctgcgcctgatgtcgggacagccctgctcccaagtacaaatagagtgacccgtaaaatctaggattttttgttttttgctacaatcttgacccctttgctacattcccttttttctgtgaaatatgtgaataataattaaacacttagacttgattcccgttctggttcctgttgtgtttttggaatgagggactggggtgggagattgaactgggagttcacactgggctctggacggaaatgtgagtgctaaacaagctgagcgccttcaggcagccccgttacttctctgacctccttcctctgtaaaaggcacctgcaccgtgccggatgatatggggatggggacatacgcg

SEQ ID NO: 31 - DNA, 6227 bp, Homo sapiens
cgcgccgccgctcgctcacctgcgctcccgcccgcccctcggtgcgcgcccggcccgccagccgccgccgcccgcaccccgagcgccaccatgaactcgctcttcaggaagagaaacaaaggcaaatacagccccactgtgcagacccggagcatctctaacaaggagctctcggagctgatcgagcagctgcagaagaatgccgaccaggtggagaagaacatcgtggacacagaggccaagatgcagagtgacctggctcggctgcaggagggtcggcagcctgagcaccgggacgtgaccctgcagaaggtgttggactctgagaagctgctctatgtgctagaggcggatgcggccattgccaagcacatgaagcacccacagggggacatgatcgccgaggatatccgccagctgaaggagcgtgtgaccaacctgcgcgggaaacacaagcagatctacaggctggcggtgaaggaagtggatccacaggtcaactgggcggcactggtggaggagaagctggacaagctgaacaaccagagctttgggactgacctgccgctggtggaccaccaagtggaggagcataacatcttccacaatgaggtcaaggccatcgggccccacctggccaaggacggggacaaggagcagaacagcgaactccgggccaagtaccagaaactgctggcagcatcacaggcccggcagcagcacctgagttcgctgcaggactacatgcagcgctgcaccaatgagctgtactggctggaccagcaggccaagggccgcatgcagtacgactggagtgaccgcaacctcgactaccccagccgccggcgccagtatgagaatttcatcaaccggaacctggaggccaaagaggagagaatcaacaaactgcacagcgagggcgaccagctgctggcggccgagcaccccgggaggaactccattgaggcgcacatggaggctgtgcacgcagactggaaggagtacctgaacctgctcatctgcgaggagagccacctcaagtacatggaggactaccaccagtttcacgaagacgtgaaggacgctcaggagctgctgcgcaaggtggactcggacctgaaccagaagtatggccctgacttcaaggaccggtaccagattgagctgctgctgcgggagctggatgaccaggagaaggtgctggacaagtatgaggacgtggtgcaggggctgcagaagcgaggccagcaggtggtgcccctcaagtaccgccgggagactccgctcaagcccatccccgtggaggcactctgtgactttgagggggagcagggcctgatctcgcggggctacagctacaccctgcagaagaacaacggggagagctgggagctcatggacagcgctgggaacaagctgattgctccggccgtctgttttgtgatcccccccacagaccctgaggccctggctctggctgacagcctgggcagccagtaccggagcgtgcggcagaaggcagctgggagcaaacgcacgctgcagcagcggtatgaggtgctgaagaccgagaatcccggagatgcctctgacctacaggggcggcagctgctggctggcttggacaaggtggccagcgacctggaccggcaggagaaggccatcacagggatcctgcggccaccactggagcaaggccgggctgtgcaggacagtgccgagcgggccaaggacctcaagaacatcaccaacgagctactgcggattgaacctgagaagacgcggagcacggctgagggcgaagccttcatccaggccctcccaggcagtggcaccacacccctgctgaggacccaggtggaggacaccaaccggaaatacgagcacctcctgcagctgctggacttggcccaggagaaggttgatgtggccaaccgcctggagaagagcctgcagcagagctgggagttgctggccacacacgagaaccatctgaatcaggatgacacagtgcctgagagcagccgtgtcctggacagcaaggggcaggagctggcggccatggcctgtgagttacaggcccagaagtccctcctgggtgaggtggagcagaacttgcaggcggccaagcagtgctcgagcacactggccagccgcttccaggagcactgcccggacctggagcgccaggaggccgaggtgcacaagctgggccagcgtttcaacaacctgcgccagcaggtggaacgcagggcgcagagcctacagagcgccaaggcagcctacgagcacttccaccgcggccatgaccacgtgctgcagttcctagtcagcatccccagttacgagccccaggagacagacagcctcagccagatggagaccaagctgaagaaccagaagaacctgctagatgagatagcaagtagggagcaggaagtacagaagatctgtgccaattcccagcagtaccagcaagctgtaaaggactatgagttagaagcagaaaaactaaggtctcttctcgacttggagaatggaaggagcagccacgtgagcaagagagccaggctccaatctcctgccaccaaagtgaaggaagaggaagcagcacttgccgccaagttcactgaagtttatgccatcaacagacagaggctgcagaatctggagtttgctctgaatctcctcagacagcagccggaagtagaagtgacccatgagaccctgcaaaggaataggccggactctggagtggaggaggcgtggaagatcaggaaggaactggatgaggagactgagcggaggcggcagctggagaacgaggtcaagagcacccaggaagaaatctggaccttgaggaatcaggggcctcaggaatcggtggtgaggaaggaggtgctcaagaaggtgccggatcccgtgctggaggagagcttccagcagctgcagcggacgctggcagaggagcagcacaagaaccagctgctgcaggaggagctggaggcactgcagctgcagctgcgtgccctggagcaggagaccagagacggggggcaggagtacgtgttcaaggaggtcctgcgcatcgagcctgacagggcccaggcggatgaggtcttgcagctgcgggaggagctggaggcactgaggcggcagaagggcgcccgggaggcagaggtgctcctcctgcagcagcgtgtggccgccctggctgaagagaagagccgggcgcaggagaaggtcacagagaaagaggtggtgaaactgcagaatgacccccagctggaggcagagtaccagcagctgcaggaggaccaccagcgccaggaccagctcagggagaagcaggaggaggagctgagcttcctccaggacaagctcaagaggctagagaaggagcgggccatggccgagggcaagatcaccgtcaaggaggtgctcaaggtggagaaggacgcggccaccgagagggaggtcagcgatctcacccgccaatatgaggacgaggctgccaaggctcgcgctagccagagggagaagacggagctgctccgaaagatatgggccttggaggaggagaacgccaaagtggtggtgcaggagaaggtgcgggagatcgtgcggccagaccccaaggcggaaagtgaagtggcgaacctccgcctggagcttgtggagcaggagcgaaagtaccggggtgccgaggagcagctccggagctaccagagtgagctggaggccctcaggaggcgaggcccccaggtggaagtcaaagaggtgactaaggaagtcattaagtacaagactgaccctgagatggagaaggagcttcagcggctcagggaggagatcgtggacaagaccagactgatcgaaaggtgtgatttagagatctaccagctgaaaaaggaaatccaggccctgaaagacaccaaaccccaggtccagaccaaagaggtggtccaggagatcctccaattccaagaagaccctcaaaccaaggaggaggtggcgtctctgagggcaaagctctcagaggagcagaagaaacaagtggatctggagagggaaagagcttcccaggaagagcagatcgcccggaaagaggaggagctctcgcgggtgaaggaaagggtggtgcagcaggaggtggtcaggtatgaggaggagccaggcctccgggccgaggcgagtgcctttgccgagagcatcgatgtggagctgcggcagattgacaagctgcgggcagagctgcggcggctgcagcgccggcgcaccgagcttgagcggcagctggaggagctagagcgcgagcggcaggcccgcagggaggccgagcgcgaggtacagcggttgcagcagcggctggcagcgctggagcaggaagaagctgaggcccgtgagaaggtaacccatacgcagaaggtggtgctgcagcaggacccgcagcaggcgcgagagcatgccctgctccgactccagctggaagaagagcagcaccggcggcagctcctggagggggagctcgagaccctccggaggaaactggctgcactggagaaggcggaggtcaaggagaaggtggtgctctccgagagtgtccaggtggagaagggcgacaccgagcaagagatccagaggctcaagagcagcctggaggaggagagccgcagcaagcgcgagctggacgtcgaggtgagccggctggaagccaggctttcggagctggaattccataactccaagtcatccaaggaactagactttctgagggaagagaaccacaaattacagctggagaggcaaaacctgcagctggagacccgaaggctccaatcggaaatcaacatggcagcgacggaaacacgagacctgcggaacatgaccgtggcggactctgggaccaaccatgactccagactgtggtccctggagagggaactggatgacctcaagaggctctccaaggacaaagacctcgagatcgacgagctgcagaagcgcctgggctccgtggccgtcaagcgggagcagcgggagaaccacctgcggcgctccatcgtagtcatccaccttgacacaggccgcgagctgtccccggaggaagcccaccgtgccgggctcattgactggaacatgttcgtgaaactcagaagccaggagtgcgactgggaggagatctcagtgaagggtcccaatggggagtcctcagtgatacacgacaggaagtctggcaagaagttctccatcgaagaggccctgcagagtggcaggctgacccctgctcagtatgaccgctatgtcaacaaggatatgtccatccaggagctggcggtcttggtatctgggcagaagtaggcacagctcttgcaactcttcgtaacggcagacgctggccctctcctacgacgcagtgacctccttggtgtcgtcctctccctagccctggtgcaggccaagcattttatacataccctcgctgccaggctgctcagagtcccgcccacatatgagacaggcactggctgaagacaggcaactctcgtcccaaccatcattcaccctgagtgacgtacttcatcctccaatgactggacaactgcgatgccttttcctcccttttcctgtacactcccagcaacaaactcctcatgataactgcacacaatctgaaaaccactgaaggacaagccaaccacagcagccaagcccactccttgcagcatgggtactggtggcacaccagacagtgacactgccccacaaaggcctgggcccgtgggggctgctgcctggcatgacatctctccagatttctggcttaaaacaactttccatccgagaagcctcctcagtagttactctgctcatgagacagatctgggctccaagccaggaaaggtgaacagaaaccacaagtgtccagccctcggtgctggagtggacgttaattgtcagccaccagactgtcccggcacctacagagaatgtttcacagttctggcatttaaatcctttgatagtggattgtgctgctgttagccttagtttcagtgctttacaagtctcgcttattatctcattggtatttaggtatacaaaacagttgattattcaccacgccaatatctgggtctctgtatctcatgtagaacataagaaaatgggaactaatagggaactttatttatagcatgaaaataaacctggtggctggagtctga

SEQ ID NO: 32 - DNA, 1642 bp, Homo sapiens
ccagatctcagaggagcctggctaagcaaaaccctgcagaacggctgcctaatttacagcaaccatgagtacaaatggtgatgatcatcaggtcaaggatagtctggagcaattgagatgtcactttacatgggagttatccattgatgacgatgaaatgcctgatttagaaaacagagtcttggatcagattgaattcctagacaccaaatacagtgtgggaatacacaacctactagcctatgtgaaacacctgaaaggccagaatgaggaagccctgaagagcttaaaagaagctgaaaacttaatgcaggaagaacatgacaaccaagcaaatgtgaggagtctggtgacctggggcaactttgcctggatgtattaccacatgggcagactggcagaagcccagacttacctggacaaggtggagaacatttgcaagaagctttcaaatcccttccgctatagaatggagtgtccagaaatagactgtgaggaaggatgggccttgctgaagtgtggaggaaagaattatgaacgggccaaggcctgctttgaaaaggtgcttgaagtggaccctgaaaaccctgaatccagcgctgggtatgcgatctctgcctatcgcctggatggctttaaattagccacaaaaaatcacaagccattttctttgcttcccctaaggcaggctgtccgcttaaatccagacaatggatatattaaggttctccttgccctgaagcttcaggatgaaggacaggaagctgaaggagaaaagtacattgaagaagctctagccaacatgtcctcacagacctatgtctttcgatatgcagccaagttttaccgaagaaaaggctctgtggataaagctcttgagttattaaaaaaggccttgcaggaaacacccacttctgtcttactgcatcaccagatagggctttgctacaaggcacaaatgatccaaatcaaggaggctacaaaagggcagcctagagggcagaacagagaaaagctagacaaaatgataagatcagccatatttcattttgaatctgcagtggaaaaaaagcccacatttgaggtggctcatctagacctggcaagaatgtatatagaagcaggcaatcacagaaaagctgaagagaattttcaaaaattgttatgcatgaaaccagtggtagaagaaacaatgcaagacatacatttctactatggtcggtttcaggaatttcaaaagaaatctgacgtcaatgcaattatccattatttaaaagctataaaaatagaacaggcatcattaacaagggataaaagtatcaattctttgaagaaattggttttaaggaaacttcggagaaaggcattagatctggaaagcttgagcctccttgggttcgtctataaattggaaggaaatatgaatgaagccctggagtactatgagcgggccctgagactggctgctgactttgagaactctgtgagacaaggtccttaggcacccagatatcagccactttcacatttcatttcattttatgctaacatttactaatcatcttttctgcttactgttttcagaaacattataattcactgtaatgatgtaattcttgaataataaatctgacaaaatatt

SEQ ID NO: 33 - DNA, 1511 bp, Homo sapiens
gaattccgggcacccctcgagcgagcgagctagccagcaggcatcgagggggcgcggctgccgtccggacgagacaggcgaacccgacgcagaagagtccaccaccggacagtcaggtagccgccgcgtccctcgcacacgcagagtcgggcggcgcggggtctcccttgcgcccggcctccgccctctcctcctctcctttccccttcttctcgctgtcctctcctctctcgctgcccgcgtttgcgcagccccgggccatgtccgacgcgtccctccgcagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggccccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaagtgtaaagctttaagagtcatttatataaaatgtttaatctctgctgaaactcagtacaaaaaaaccgggattccggcc

SEQ ID NO: 34 - DNA, 3407 bp, Homo sapiens
cgcgcgtctccgccgcccgcgtgacttctgcctgcgctccttctctgaacgctcacttccgaggagacgccgacgatgaagacaccgtggaagattcttctgggactgctgggtgctgctgcgcttgtcaccatcatcaccgtgcccgtggttctgctgaacaaaggcacagatgatgctacagctgacagtcgcaaaacttacactctaactgattacttaaaaaatacttatagactgaagttatactccttaagatggatttcagatcatgaatatctctacaaacaagaaaataatatcttggtattcaatgctgaatatggaaacagctcagttttcttggagaacagtacatttgatgagtttggacattctatcaatgattattcaatatctcctgatgggcagtttattctcttagaatacaactacgtgaagcaatggaggcattcctacacagcttcatatgacatttatgatttaaataaaaggcagctgattacagaagagaggattccaaacaacacacagtgggtcacatggtcaccagtgggtcataaattggcatatgtttggaacaatgacatttatgttaaaattgaaccaaatttaccaagttacagaatcacatggacggggaaagaagatataatatataatggaataactgactgggtttatgaagaggaagtcttcagtgcctactctgctctgtggtggtctccaaacggcacttttttagcatatgcccaatttaacgacacagaagtcccacttattgaatactccttctactctgatgagtcactgcagtacccaaagactgtacgggttccatatccaaaggcaggagctgtgaatccaactgtaaagttctttgttgtaaatacagactctctcagctcagtcaccaatgcaacttccatacaaatcactgctcctgcttctatgttgataggggatcactacttgtgtgatgtgacatgggcaacacaagaaagaatttctttgcagtggctcaggaggattcagaactattcggtcatggatatttgtgactatgatgaatccagtggaagatggaactgcttagtggcacggcaacacattgaaatgagtactactggctgggttggaagatttaggccttcagaacctcattttacccttgatggtaatagcttctacaagatcatcagcaatgaagaaggttacagacacatttgctatttccaaatagataaaaaagactgcacatttattacaaaaggcacctgggaagtcatcgggatagaagctctaaccagtgattatctatactacattagtaatgaatataaaggaatgccaggaggaaggaatctttataaaatccaacttattgactatacaaaagtgacatgcctcagttgtgagctgaatccggaaaggtgtcagtactattctgtgtcattcagtaaagaggcgaagtattatcagctgagatgttccggtcctggtctgcccctctatactctacacagcagcgtgaatgataaagggctgagagtcctggaagacaattcagctttggataaaatgctgcagaatgtccagatgccctccaaaaaactggacttcattattttgaatgaaacaaaattttggtatcagatgatcttgcctcctcattttgataaatccaagaaatatcctctactattagatgtgtatgcaggcccatgtagtcaaaaagcagacactgtcttcagactgaactgggccacttaccttgcaagcacagaaaacattatagtagctagctttgatggcagaggaagtggttaccaaggagataagatcatgcatgcaatcaacagaagactgggaacatttgaagttgaagatcaaattgaagcagccagacaattttcaaaaatgggatttgtggacaacaaacgaattgcaatttggggctggtcatatggagggtacgtaacctcaatggtcctgggatcgggaagtggcgtgttcaagtgtggaatagccgtggcgcctgtatcccggtgggagtactatgactcagtgtacacagaacgttacatgggtctcccaactccagaagacaaccttgaccattacagaaattcaacagtcatgagcagagctgaaaattttaaacaagttgagtacctccttattcatggaacagcagatgataacgttcactttcagcagtcagctcagatctccaaagccctggtcgatgttggagtggatttccaggcaatgtggtatactgatgaagaccatggaatagctagcagcacagcacaccaacatatatatacccacatgagccacttcataaaacaatgtttctctttaccttagcacctcaaaataccatgccatttaaagcttattaaaactcatttttgttttcattatctcaaaactgcactgtcaagatgatgatgatctttaaaatacacactcaaatcaagaaacttaaggttacctttgttcccaaatttcatacctatcatcttaagtagggacttctgtcttcacaacagattattaccttacagaagtttgaattatccggtcgggttttattgtttaaaatcatttctgcatcagctgctgaaacaacaaataggaattgtttttatggaggctttgcatagattccctgagcaggattttaatctttttctaactggactggttcaaatgttgttctcttctttaaagggatggcaagatgtgggcagtgatgtcactagggcagggacaggataagagggattagggagagaagatagcagggcatggctgggaacccaagtccaagcataccaacacgagcaggctactgtcagctcccctcggagaagagctgttcaccacgagactggcacagttttctgagaaagactattcaaacagtctcaggaaatcaaatatcgaaagcactgacttctaagtaaaccacagcagttgaaagactccaaagaaatgtaagggaaactgccagcaacgcagcccccaggtgccagttatggctataggtgctacaaaaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatacaatgttatgtattattattcccattctacatactatggaatttctcccagtcatttaataaatgtgccttcattttttc

SEQ ID NO: 35 - DNA, 6803 bp, Homo sapiens
agatctatcatgatggccacatgaacacaggcttcactggtcttaccatatgcccatgacccagaagcagccagcctgagagaacaatggaacaaagtgacttaatttccaaagttctgggggtttataaacagcatatggtatgtcacatgactactgtgggattggaaaaagatcatgtaaatagagcactttgcacagaccctggcatgcagcaagtgctcaataaatgataggtgttgtttactaattggactgaatggtgaaaggcctgtgtgccccagggggagctggtgatcaggcttcactaagcccagtatggccgtggctctcatctcagtgtgacatgctttgaatacccttagcggctccaaaagtcctcagcttgaagtgcatttttctgccagcaggcagcacacaaatgttccgctgggcggagctgggagagaggggaaaatgaaactctgcagagtgcaggagctgggagagaggggaaaatgaaactgcagagtgcagaaatagaaactccgacagggattggctgcctagggtgagacgtgggaggatccacaagtgatgataaaaagccagccttcagccggagaaccgtttactcgctgctgtgcccatctatcagcaggctccgggctgaagattgcttctcttctctcctccaaggtaaactcaggagcttatgaagtgtgggcattcaagctgccaccctctgccaggctgcctgtctgcctgtaaatctcatgttctgagagccaggaggccccttctcctgggaggcagcactcctgggtcccttttagtgctctgggctgggacttgtctaagaggatgggttggagatttttagggagatgggatgcaaaaccccaagtggcatgagacccagcttacaggtgcaatatcagcgatctgtggccttaacactgtcacctcttggagccttaattacttcctctgtaaaaggaaagttaagttgcctttgctgctcaaaggactggagtattttagaatcccctttattataggatccaatgtgacagtgagttcatctttaaggatagatgaagccatctggagtggttgttaaaaatgtgggcttggtggccaggcgtggtggttcacgcctgtaatcccagcactttgggaggccgagacccacggatcacgaggtcaggagatcgagaccatcctggctaacacagtgaaaccctgtctctactaaaaatacaaaaaaaattagccgggcttggtggtgggcgcctgtagtctcagctactcgggaggctgaggcaggcaggagaatggcatgaacctgggaggtggagcttgcagtgagatgagattgcgccactgcactccagcctgggcgacagagaaagactccatctcaaaaaaaaaaaaaaaaaaaatgtgggcttgggtattagccaattgtgggtttaaaccctgactttgccatgacctggctaggcagccttgggaatattacttaacctctctgagcttcagtttccttatctataacatgtggttgataacaatggtacctacttcgtggtgttgttataggtacaagtggactgcgtgccataaagtgctaagtactcaatacatgagaggagtttcttgtttttctttttaacttaagaaaatagcattgatctgacaaagatcatattagaggtgagtctgagggcatatgcattttccagttttgtggtataaaggaaagagcataggttcatgaattctgactgtcttgaatgtgtacccatgttgcacaatttgctgtgtgacctttatcccttgtgatattgtaaaatatattttttcatcccccagttcctggcatacaactcctaaaatccttggaatcttcaaagtgataaatatcttttgagtgataactgtctaataagttgactgatggctggcatttcctctggggaggggagaggggctgaaggttaagctgattaccaatgggcagtgatttaatcagtcatgcctatgtaatgaagcctccataaaaacacaaaaggacagggtttgacaagcttccagatagccgaatacaggaggtctccagtgggtggtgcttctggagaggaatggaaactccatgccctttctcccataccttgccctatgcatctcttcatctggagcatttgtaatatccataaggaaccagtaaatgtagctgggtatggtggctgatgcctgtaatctcagcactttgggaggctgaggcaggcagattgcgtgagttcaggagttcaagatcagcctgggcaacatggtgaaaccccatctcaaaaaaaaaaaaaaaaattagttgggcgtggtggtgcatacctgtagtcccagctatctggaggctgaggtgggaggatcacttgagcctgggaggcgaaggtctcagtgagctgagatggggccactgcactccagcctgagcaatagagtgagaccctgtctcaaaacaacaacaagatcaattttttttttttaaagaaagaaaccagtatatgtaagtaaagtgtttccctgagttctgtgagctgctctagcaaattagtaaaactgcaggagggaattgtgggaaccccagtttatagtcagtcagaaacacaggtaaaacaacctagggcttcgattggcagtctgggggactgaaccctcaacatgtgggatcggccactatctacccatagtggtgtcagaattgaatttggggaccctcagctggtgttcaccagaggactgattgtttgcttgctggtggggagaaacccccacacttctgctgtcagaagcctctcgtacggtgagggaaactgagtttctttttccacacacccttctgtgctttctttctgaaaaaaaaattaagttgatgtgaggccaacgtttggtgccagtagatattcaatgcattgtaagaatgagtttgtcttaaaaatttttttaaagcaaattctatgcgtcaggcactgttcaaagtgcgggatacagcgtggaacagttattaaattaacaagtaccctctgaaatagactctattaataccccaattttagaaataaacaaactgaagcccagagaagcaaagtaccctagtatcctgcccaaggtcacttgggtacaaggccaagaacaaccacagtcatgatattgacatctgcggacgttaccacgtgccaaacaccgtgcgaatccgcacagaatccgcacacccaccggttggggcagggacatctctgccactgatgcggagaggaaacggattcccgaggctcctgagagggatcctgggttccattcaccacacctcgctgctttttactgattcagttggaactggaagggaaaacaacggagctgatgagctccaaaaatgctccggggaccatctccctctcgcccgttcgcaggtctagtgacggagcccgcgcgcggcgccaccatgcggcagaaggcggtatccgttttcttgtgctacctgctgctcttcacttgcagtggggtggaggcaggtgagaatgcgggtaaggatgcaggtaaggggacaggtaagggtgcaggtaaggatgcaagtaagggtgcaggtaaggatgcgggtaaggatgcaggtaaagatgcgggtaaggatgcaggtaaggatgcgggtaaggatgcaggtaagggtgcaggtaaggatgcgggtaaggatgcaggtaaggatgcaggtaagggtgcaggtaaggatgcaggtaaggatgtgggtaaggatgcaggtaagggtgcaggtaagggaacagataagggtgcaggtaaggggacaagtaaggaggcatataagggtgctgggggatgggaggagtgtgggataaaggagagagtttcagggtccggggtgtagagggtctggcgtgcttctgtagagaccctggcgtccattccaatggacagcgcagggttggtgtcgccagagtcccagattcaaatcccactactctgttcattcctccatcctaccgaaatttactcgatgctagttctgtgccagctcggcgcctaggggaaagtcccttcccctctgtgaggctctctgagtaggagagtggtggcccccgcctccaggagtggtcctgagcatcagacacagagtaggggacccctgtgtcccaccccaacaaccccactacgctttgtctgctctcctgcaggtaagaaaaagtgctcggagagctcggacagcggctccgggttctggaaggccctgaccttcatggccgtcggaggaggtgggtctggagggcgaggatctcgggcaggcggggcgggcctctgccgcggacgctccctcacctgctcctgttcctccaggactcgcagtcgccgggctgcccgcgctgggcttcaccggcgccggcatcgcggccaactcggtggctgcctcgctgatgagctggtctgcgatcctgaatgggggcggcgtgcccgccggggggctagtggccacgctgcagagcctcggtgagtgcggggcctgggcctggtgggacgttctttactattattttcatcatacatctggggaaactgaggcactcaggaattaagtaatttactcaagtaattaagtagtttaccaggaattaagtgattctttatttatttattttgagacagagtctggctgtgtcacccaggcaggctgaagtgcagtggtgtgatcttggctcactgcaacctctgcctccctggctcaagcgattttcctgccacagcctcccaagtagctgggattacaggcacacgccaccacgcccggctaatttttgtatttttagtagagatggggtttcaccatgttggccaggctggctcaaactcctgacctcagctgatccgcccgcctcggcgtcccatagtgctaggattacaggcgtgagtcaccgcgtccggccagaaattaagtaacttactcaagtctccctgctagtttagaccagagcctagattctgacccagtcagtacaatgcgagaagccccattctcagcctcaaaggctgggtgcctcactgatgctttggccaaatcacaagcctcagttccctcagcggtgcgtggggatgatcatcctcagtttaacattttttgaatctgctcaatctcagagaccacagtagcaaagaaacatagtagagtaactcaaatcaatctcacaccaaactggtcttgacttgcactttttgaacaccatggagggaacagataacagagctcacagtgactcttctatcgattgatcaatctattgatctatttattatagataaaggtcaaaacaaggtctcacactgccaggttggaatgcagtgcatgatcacagctcacagcagcctcgaactcccaggttcaagctatcttcctgcctcagattcccaagtagctgggactataggcgcataccgccacacactggcttttttttttttttttttttttttttttgtagagacggggtctcattgtgttgcccaggatggtcttgaattcctgggctcaagcaatcctcccactttggcctcccaaagtgttgagactgcaagcatgagccactgtgctggcccagagtgactcataaaaaatggccttacttccctctctctcctctctccccacccacccccacctctctctcgcgctctgaggcctccaaaatcctggagaaaacctgcccctgacaaacttccctctctgcctttctgaacctcgcatctcctcttctctcaattctgaatggcaaaagcccaaagaaccagcccaaaagaagagagccctgctcagacggggccacacccctgcaatgggaggggaagagtgtgggcgagcccagggacacctctgggctatcagctagttgtcctctcacatggcacatagctgtgacaagatgaaatgatccctggcttgtgaaccccccacacccacacagggctccatgaaggtggctgttagcatgattaataacatggcgtttccatggcagacatcaggtgaaggagccattatttttgcctttttcatcactgaaacacatctctgatttgggatgtcaaggcaaggtaaaaatgggactcactttgtagtagtgccatcccctctcagggcctctgtttctccatctagacataaggggttggactcaaccaatggtttccagacatttggattcccaggcctggcacttgggcccagtgactcatctgtgtttgctttacaggggctggtggcagcagcgtcgtcataggtaatattggtgccctgatgcggtacgccacccacaagtatctcgatagtgaggaggatgaggagtagccagcagctcccagaacctcttcttccttcttggcctaactcttccagttaggatctagaactttgcctttttttttttttttttttttttttgagatgggttctcactatattgtccaggctagagtgcagtggctattcacagatgcgaacatagtacactgcagcctccaactcctagcctcaagtgatcctcctgtctcaacctcccaagtaggattacaagcatgcgccgacgatgcccagaatccagaactttgtctatcactctccccaacaacctagatgtgaaaacagaataaacttcacccagaaaacactttgtcctgctgtcaatcatgtttgcagtgagaagcccaaaacaatctggctctggcctgcaccatccacacacccccattcccattttcccctcgag

SEQ ID NO: 36 - DNA, 1636 bp, Homo sapiens
ccaggagccccagttaccgggagaggctgtgtcaaaggcgccatgagcaagatcagcgaggccgtgaagcgcgcccgcgccgccttcagctcgggcaggacccgtccgctgcagttccgattccagcagctggaggcgctgcagcgcctgatccaggagcaggagcaggagctggtgggcgcgctggccgcagacctgcacaagaatgaatggaacgcctactatgaggaggtggtgtacgtcctagaggagatcgagtacatgatccagaagctccctgagtgggccgcggatgagcccgtggagaagacgccccagactcagcaggacgagctctacatccactcggagccactgggcgtggtcctcgtcattggcacctggaactaccccttcaacctcaccatccagcccatggtgggcgccatcgctgcagggaacgcagtggtcctcaagccctcggagctgagtgagaacatggcgagcctgctggctaccatcatcccccagtacctggacaaggatctgtacccagtaatcaatgggggtgtccctgagaccacggagctgctcaaggagaggttcgaccatatcctgtacacgggcagcacgggggtggggaagatcatcatgacggctgctgccaagcacctgacccctgtcacgctggagctgggagggaagagtccctgctacgtggacaagaactgtgacctggacgtggcctgccgacgcatcgcctgggggaaattcatgaacagtggccagacctgcgtggccccagactacatcctctgtgacccctcgatccagaaccaaattgtggagaagctcaagaagtcactgaaagagttctacggggaagatgctaagaaatcccgggactatggaagaatcattagtgcccggcacttccagagggtgatgggcctgattgagggccagaaggtggcttatgggggcaccggggatgccgccactcgctacatagcccccaccatcctcacggacgtggacccccagtccccggtgatgcaagaggagatcttcgggcctgtgctgcccatcgtgtgcgtgcgcagcctggaggaggccatccagttcatcaaccagcgtgagaagcccctggccctctacatgttctccagcaacgacaaggtgattaagaagatgattgcagagacatccagtggtggggtggcggccaacgatgtcatcgtccacatcaccttgcactctctgcccttcgggggcgtggggaacagcggcatgggatcctaccatggcaagaagagcttcgagactttctctcaccgccgctcttgcctggtgaggcctctgatgaatgatgaaggcctgaaggtcagataccccccgagcccggccaagatgacccagcactgaggaggggttgctccgcctggcctggccatactgtgtcccatcggagtgcggaccaccctcactggctctcctggccctggagaatcgctcctgcagccccagcccagccccactcctctgctgacctgctgacctgtgcacaccccactcccacatgggcccaggcctcaccattccaagtctccacccctttctagaccaataaagagacaaatacaattttctaactcgg

SEQ ID NO: 37 - DNA, 2787 bp, Homo sapiens
agagcggaggccgcactccagcactgcgcagggaccgccttggaccgcagttgccggccaggaatcccagtgtcacggtggacacgcctccctcgcgcccttgccgcccacctgctcacccagctcaggggctttggaattctgtggccacactgcgaggagatcggttctgggtcggaggctacaggaagactcccactccctgaaatctggagtgaagaacgccgccatccagccaccattccaaggaggtgcaggagaacagctctgtgataccatttaacttgttgacattacttttatttgaaggaacgtatattagagcttactttgcaaagaaggaagatggttgtttccgaagtggacatcgcaaaagctgatccagctgctgcatcccaccctctattactgaatggagatgctactgtggcccagaaaaatccaggctcggtggctgagaacaacctgtgcagccagtatgaggagaaggtgcgcccctgcatcgacctcattgactccctgcgggctctaggtgtggagcaggacctggccctgccagccatcgccgtcatcggggaccagagctcgggcaagagctccgtgttggaggcactgtcaggagttgcccttcccagaggcagcgggatcgtgaccagatgcccgctggtgctgaaactgaagaaacttgtgaacgaagataagtggagaggcaaggtcagttaccaggactacgagattgagatttcggatgcttcagaggtagaaaaggaaattaataaagcccagaatgccatcgccggggaaggaatgggaatcagtcatgagctaatcaccctggagatcagctcccgagatgtcccggatctgactctaatagaccttcctggcataaccagagtggctgtgggcaatcagcctgctgacattgggtataagatcaagacactcatcaagaagtacatccagaggcaggagacaatcagcctggtggtggtccccagtaatgtggacatcgccaccacagaggctctcagcatggcccaggaggtggaccccgagggagacaggaccatcggaatcttgacgaagcctgatctggtggacaaaggaactgaagacaaggttgtggacgtggtgcggaacctcgtgttccacctgaagaagggttacatgattgtcaagtgccggggccagcaggagatccaggaccagctgagcctgtccgaagccctgcagagagagaagatcttctttgagaaccacccatatttcagggatctgctggaggaaggaaaggccacggttccctgcctggcagaaaaacttaccagcgagctcatcacacatatctgtaaatctctgcccctgttagaaaatcaaatcaaggagactcaccagagaataacagaggagctacaaaagtatggtgtcgacataccggaagacgaaaatgaaaaaatgttcttcctgatagataaaattaatgcctttaatcaggacatcactgctctcatgcaaggagaggaaactgtaggggaggaagacattcggctgtttaccagactccgacacgagttccacaaatggagtacaataattgaaaacaattttcaagaaggccataaaattttgagtagaaaaatccagaaatttgaaaatcagtatcgtggtagagagctgccaggctttgtgaattacaggacatttgagacaatcgtgaaacagcaaatcaaggcactggaagagccggctgtggatatgctacacaccgtgacggatatggtccggcttgctttcacagatgtttcgataaaaaattttgaagagttttttaacctccacagaaccgccaagtccaaaattgaagacattagagcagaacaagagagagaaggtgagaagctgatccgcctccacttccagatggaacagattgtctactgccaggaccaggtatacaggggtgcattgcagaaggtcagagagaaggagctggaagaagaaaagaagaagaaatcctgggattttggggctttccagtccagctcggcaacagactcttccatggaggagatctttcagcacctgatggcctatcaccaggaggccagcaagcgcatctccagccacatccctttgatcatccagttcttcatgctccagacgtacggccagcagcttcagaaggccatgctgcagctcctgcaggacaaggacacctacagctggctcctgaaggagcggagcgacaccagcgacaagcggaagttcctgaaggagcggcttgcacggctgacgcaggctcggcgccggcttgcccagttccccggttaaccacactctgtccagccccgtagacgtgcacgcacactgtctgcccccgttcccgggtagccactggactgacgacttgagtgctcagtagtcagactggatagtccgtctctgcttatccgttagccgtggtgatttagcaggaagctgtgagagcagtttggtttctagcatgaagacagagccccaccctcagatgcacatgagctggcgggattgaaggatgctgtcttcgtactgggaaagggattttcagccctcagaatcgctccaccttgcagctctccccttctctgtattcctagaaactgacacatgctgaacatcacagcttatttcctcatttttataatgtcccttcacaaacccagtgttttaggagcatgagtgccgtgtgtgtgcgtcctgcggagccctgtctcctctctctgtaataaactcatttctagcccg

SEQ ID NO: 38 - DNA, 594 bp, Homo sapiens
gtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcac

SEQ ID NO: 39 - DNA, 867 bp, Homo sapiens
ggctcagcacaggcacaaaccattgcccggcactggcccgtgctgcctgagaaggattggcacgggcacagaccactgcccccacctgccctgcgccatctacccaagaaggctcggcacgggcaccaaccactgcctccaactgccccatgctgcctgagaaggcactgcacggccacccccaactgccccgcactgtccctacccgggcagccatgcgagcggctggaactctgctggccttctgctgcctggtcttgagcaccactgggggcccttccccagatacttgttcccaggaccttaactcacgtgtgaagccaggatttcctaaaacaataaagaccaatgacccaggagtcctccaagcagccagatacagtgttgaaaagttcaacaactgcacgaacgacatgttcttgttcaaggagtcccgcatcacaagggccctagttcagatagtgaaaggcctgaaatatatgctggaggtggaaattggcagaactacctgcaagaaaaaccagcacctgcgtctggatgactgtgacttccaaaccaaccacaccttgaagcagactctgagctgctactctgaagtctgggtcgtgccctggctccagcacttcgaggtgcctgttctccgttgtcactgacccccgcctcttcagcaagaccacagccatgacaaacaccaggatgcatgctccttgtcccctcccacccgcctcatgacccagcctcacagaccctctcaggcctctgacgagtgagcgggtgaagtgccactgggtcaccgcagggcagctggaatggcagcatggtagcacctcctaacagattaaatagatcacatttgcttctaaaatt

SEQ ID NO: 40 - DNA, 2500 bp, Homo sapiens
cccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggttgacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgttttgtactcacggcggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcataaaaaaaaaaaaaaaaaaaaaaaaa

SEQ ID NO: 41 - DNA, 3308 bp, Homo sapiens
ggcggccgcgctcgtcggggccgggggcggggccgatccctccggcttcccgcttcccgcggagaacaacaatgaaagtgaaagaggggtggggcgggggcgagcccgggttctgtggcccatttgccctgtggccttgagcaagcccctcccccaggcctcgggggctctcccggtttgggggaaccgggcgaggcaatgccacaggcccagggttagagggggtgggcacttgcagctgccgatgtggctggatctggaacttctcggagacggctcctgtcagcgccaagtttcaccaaatccaggcctgcccctcctcccccaggacccccactcgcagtccctcaagcctgtgctcccggaaaggcactgggcgaccgcacccgtggctttctctgggcgaccgggtcccagactccccccagcacagcagagcgcttccctgcccaccccggaaaccgccccaggtggccgcgccccctccccagcagccagcagggcgccagggctgagccggccgtggaggggagcgggtcccgcggttatacaggcgccggggctccgcggcaggcaagagaagctgaggcctgagaacggcccaaaccttggcgtacggcaggggacgacctgggatgggggcagcgggcggcggcgcagggagtgggccgggggccggtgtgcgcgggcgggacggggcccggggtcgggagacaccgcttggaagatggggccgggagaggcgccgtcgcagcgcagagggcaccggcggggagacgcgaggacgcggggcccgggaacacggacgccggagtagaagcgcggggggccgggctggagcgggggcggggacgcgggggtcgggggcggtgcgggtttgaggggagggggcgggcgggtccttccctgggggggtggggagagggggcgggggcccatgtgaccggctcagaccgttctggagacaaaaggggccgcggcggccggagcgggacgggcccggcgcgggagggagcgaagcagcgcgggcagcgagcgagtgagcgcgcggcgggcccctggtccgccggcccgcggccgatctaggggctgggggctggaggcggggtgggggtctgagctgcgtcctgggctcgaggcgtcccccgggggagtcgcctcttagcggtgcgtccgggctagcggcgaggggccgccccaagtcttcccaccgccgccaccttagcagcccgacttggggcctggaaagtggagcacgcggaggtgggagggccctgcacgcggccccggtgggaaaggggacgggccagggattcagactcgggctctcccctcaggatgcagcaccgaggcttcctcctcctcaccctcctcgccctactggcgctcacctccgcggtcgccaaaaagaaaggtgatgggggatgatcgaaggagggctggggacgggcaggcaggcccctccacttctggctggccgcctggttcctagcctggaacccaggaaggcggctcccgagggagtctccccgtgccccagtcctgaactctgttcctcgcgcgtgtagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggaggtaggcgggcgcagtcagagggcagagacgggggcacagcctcgccgaagcctgggcggacccttggcggagggcggggccgcgggcgcgcagcgctgacctgggccgctctctcgccagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaaggtcagcgaaaggagaagggggtggggctgtcgcggggggctgcccccccccccccgcctgtgaggggacaattccaagttaaaccttaagttttgagtcctggccagtggcttcctgacatcgcctcacttggcttccctgcctggaaaagtctgaagatgggcactacaagagaggccgcaggtgatgctggggacataaatcctccctggcccaaatagggaccaactcaaactactccattggagcatctggcttaggacccagggagagagtcctggaacggcttgcctttggtcagctctccagccacgggcagcatttggtcagctctgccctttctagtgttgggaggaggtcaaggcccaccctgggcctctcagctcactcgtgactcagcccagcgaggccagcagggcaggggtgaatctgcccgcttctcaggtgaggaggctgaggatgcccagggctgctgtgaccaggactaggactggaaacttgaaggttttctgatcccaagtggaaataggaagctggggatgtcccatgtccacatcacaatggctgccccatcccctgcttccgagtcagctgattggaaaccactaggggcagatcttctccttccctgatgcccgggtgtttgtggagccggcggtctgcaatgggtcagcctaactgctgatatggtattaatatttctttcttgttttacagccaagaaagggaagggaaaggactagacgccaagcctggatgccaaggagcccctggtgtcacatggggcctggccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaatataaagccccttcccaaggagtttgctgtggaaatgtgtttgggagtgggaaggtggggagaaagaccaggctgtagggactggtgggtttcagggggcttggtggtgggtgctctccagagctcatggaaaaagcagaacaattacaacatttcttccagggcccctgaaaggtgctccccatcaagtcacctaagcctttcggtcctcatctccctca

SEQ ID NO: 42 - DNA, 1511 bp, Homo sapiens; identical to SEQ ID NO: 33

SEQ ID NO: 43 - DNA, 1642 bp, Homo sapiens; identical to SEQ ID NO: 32

SEQ ID NO: 44 - DNA, 2607 bp, Homo sapiens
attaaacctctcgccgagcccctccgcagactctgcgccggaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagtgtaagtgaacacagaagagtgacatgtttacaaacctcaagccagccttgctcctggctggggcctgttgaagatgcttgtattttacttttccattgtaattgctatcgccatcacagctgaacttgttgagatccccgtgttactgcctatcagcattttactactttaaaaaaaaaaaaaaaagccaaaaaccaaatttgtatttaaggtatataaattttcccaaaactgataccctttgaaaaagtataaataaaatgagcaaaagttgaa

SEQ ID NO: 45 - DNA, 1651 bp, Homo sapiens
ctgcgaaccctctctactctccgaagggaattgtccttcctggcttccactacttccacccctgaatgcacaggcagcccggcccaagtctcccactagggatgcagatggattcggtgtgaagggctggctgctgttgcctccggctcttgaaagtcaagttcagaggcgtgcaaagactccagaattggaggcatgatgaagactctgctgctgtttgtggggctgctgctgacctgggagagtgggcaggtcctgggggaccagacggtctcagacaatgagctccaggaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggatgccctaaatgagaccagggaatcagagacaaagctgaaggagctcccaggagtgtgcaatgagaccatgatggccctctgggaagagtgtaagccctgcctgaaacagacctgcatgaagttctacgcacgcgtctgcagaagtggctcaggcctggttggccgccagcttgaggagttcctgaaccagagctcgcccttctacttctggatgaatggtgaccgcatcgactccctgctggagaacgaccggcagcagacgcacatgctggatgtcatgcaggaccacttcagccgcgcgtccagcatcatagacgagctcttccaggacaggttcttcacccgggagccccaggatacctaccactacctgcccttcagcctgccccaccggaggcctcacttcttctttcccaagtcccgcatcgtccgcagcttgatgcccttctctccgtacgagcccctgaacttccacgccatgttccagcccttccttgagatgatacacgaggctcagcaggccatggacatccacttccacagcccggccttccagcacccgccaacagaattcatacgagaaggcgacgatgaccggactgtgtgccgggagatccgccacaactccacgggctgcctgcggatgaaggaccagtgtgacaagtgccgggagatcttgtctgtggactgttccaccaacaacccctcccaggctaagctgcggcgggagctcgacgaatccctccaggtcgctgagaggttgaccaggaaatataacgagctgctaaagtcctaccagtggaagatgctcaacacctcctccttgctggagcagctgaacgagcagtttaactgggtgtcccggctggcaaacctcacgcaaggcgaagaccagtactatctgcgggtcaccacggtggcttcccacacttctgactcggacgttccttccggtgtcactgaggtggtcgtgaagctctttgactctgatcccatcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccccccagagagagctctgcacgtcaccaagtaaccaggc

SEQ ID NO: 46 - DNA, 896 bp, Homo sapiens
ggggaaagcagcccattcctgggtcagagactcccaccccagctcagagggagcaggggcccagcagggacggaccctcattcctcccagggaccccagacctctgtctctctcgggccttggctccttgaacttttggccgccatgtgcttcccgaagtcctctctgatgacatgaagaagctgaaggcccgaatgcaccaggccatagaaagattttatgataaaatgcgaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgataaggtcatgaggtggttccaggccatgctgcgacggctgtagacctggtggcacggggtcctggcctgggtgaaggagaaggtggtggccctggtccatgcagtgcaggccctctggaaacagttccagagtttctgctgctctctgtcagagctcttcatgtcctctttccagtctacggagcacggggggacaaggaggagctgacaccccagaagtgttctgaaccccaatcctcaaaatgaagatactgacaccacctttgccctccccgtcaccgcgcacccaccctgacccctccctcagctgtcctgtgccccaccctctcccgcacactcagtccccctgcctgggcgttcctgccgcagctctgacctggcggtcgccctggcatcttaataaaacctgcttatacttcctggcaggggagatacc

SEQ ID NO: 47 - DNA, 1377 bp, Homo sapiens
aacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtcagttgactggcagctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaattgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccacgcctgtgatcctggacccggcggaccctacaggaaacttgggtggtggagacccaaagcgttggaggcagctggcacaagaggctgaggcctggctgaattacccatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacacc

SEQ ID NO: 48 - DNA, 1594 bp, Homo sapiens
gcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtag

SEQ ID NO: 49 - DNA, 148834 bp, Homo sapiens
gatctgaacttctttttattattattattttaaatatgaggtctcactatgttctccaggctggagagcagtgactattcacaggtgtgaccatagcctcaaattcgtgagctcgagccattctcctatctcagcctcctgagtagctgggactacaggtgcccaccacagtgttcagccacttttcattgttattttacttcaaatgttttattttgaatgttaaaaatacatgtttctacattagaaatatgaaaatgtatttgattacagaagaatttaaaatgcacacatcaacacctggttgaattttaaagaaaaaaaaatgcagagaagaaagaaatatcacccaggcttcccctccaaagaaccactgctatcatattattgaaacttcctggactgcagtgtgaatggtcatccctggagctatcttctgcagtgatgctgacttccattcttttgttttctatgtatatatttttatatatgctttcattgtagaaagttgcattcataagttttggggttttttttaagatggagtctcactctgtcccccaggggctggagtgcagtggcatgatctcggctcactgcaacctctgcatctcggatgcaagtgagtcttctgcctcagcccctcgagtagctgggattacagatgtgcactaccacgcctggctaattttgtgtttttaatatagatggggttacacttgttggccaggctggttttgaacacctgacctcaagtgatccacccaccttggcctcccagagtggttgtgggttattttgaagttgctttttgaatgtattattatgaaagtagttttccatgtcataaagtctgcataaaatttacacacttctagaagctgcatcccatctcaaacaaggagaagtcaccagggttcttttagatccatgtgctttcatcttgtcttttggtaaagaatattttgacaagcatgtttgtacatgaagattcttctatggttgtgattttaaaaattcatagaacactcaggatggacatggtggctcatgcctgtacttccagcactttgggaggctcaggctggcagattgcttgagcccctgagtttgtgaccagcctaggcaacatagagaaaccctgtctctacaaaaaattcaaaagaattagccgggcttggtggcacatgcctgtagtcccagctacttgggtgtctgaggtgggagggttgcttaagcctggaagattcaggctgcagtgagccatgaacaacactgcactccagccagcaagcccaatctcaaaaaaataaattatagactactcaaattgtaagtattaaaccagtgtctgtgagagtttttctggaagggatgtgagtgggtggactggtggggaagatgctctctcactgtgggcagccacagtccaatcacctagtggcccagatagaacagaaaggtagatagaagtaaaatttctctctgtctctgtctctctgtctctctctgtctctgtctctctctctggaactggggctgggacacccttcttctcctgccttggacatcaaaactccaggttcgatgatctttggactctgacttttgcaccagtgagcccctttatcctcctgttctgtattctgggtcctcagggctttgactttggactgagccacgctactggcttttctagttctccagcttccagacagtctatcatgggacttctcagcctccataattgtgtgagccaattagcccaataaatcacctatctatctgtctgtctatctatctatctatctatctatctatctatctatctatcatcatctaacatctatctatcatctatcatctatctatctattatctatctatcatctatgtacctatgctattggttctttctttcttggtaaccttaataaatcaacagacaataaacaaataaaacctgtcatagtatcactgataattgccattaagaaaaatatgcttgggttagaagattggtggcggtggtgggaatggcaggggatagatttcagaagaggtcactggacaagacatttctgaacacttgaccatgggacatttaagcagggaccttaatggtgtgaggagtgagccatgtggatcactgggcagcacatgcatgtgggagtcacagcaggggcaggtggtagagacagggtggagtagacaagaaactggtgtgagtggagaagaatgagctaggctgagagtaatgggatgaggccaaagtggccagaggggaccctgtgataaggagtgcataggaaatggtgggaaactggggtttccttgtgcctaagaagggaaggagctggagcgttcataggatatgccctaattcccattggaaaggcacgctctctctgttgtgtgggtgatggacagtgggcatgagagtcagcaggcagcccagctggaaggcccttccggttttctatcctagtgaggatggttctggggtggaggtggcagaggagtgagaagtgattggatttggtgttgatatatatttttaaaattgtggtaaaacacacatactatacgatttaccttctaacaatttttttcagtgtacaattcattggcattaagcacatttacaattgatggtggttacacaaacaccaacatgcattttcagaacattttcatcatcccaacagagactgtacccattaaatgacagctgcccattgttcctgccttcagcccctggtaacctgtattctactttctgtttttgtgaatttgcttattctaggtgcctcatataagtgaaatatcatatttgccttttttttggcttattttatttagcgtgttttcaaggttccatccaatccaaatattcttcacttttaaggctgattaatattccatgtgtatatgcaccacattttgtttttccaatcatcctctgatggacacttgggttgcgtccaccttttggctattgggaatagcactgctatgagcatgactgtacaattatctgtgtgcatacctgctttcaatttttggggggtatacacccaaaagtggaattgttgcttcatatggaaattctatgtttaccttcttgagaaagcgtcatcctgtttccatgatggctgcactgttgttcactctcagcagcagtgcacaagcattccattttctccacatcctcaccaacacctggactagtgaagctgagcatattttcatgtccttattggaattccttatttttatgtccttactgtgtatcttctctggagaattgtctattcatgtcttttacccatttttgaatgagattgttttgctattgttaagttgtagttctgtatgtagtctggatattaattctttatcagatatgtgattggcaaatattttatcttattctatgcagtttcttttattttcacttttttttttttttttttttttttttttttttttgagacggagtctctctctgatgccccagctggagtgcaatggtgcaatctcagctcattgcaacctctgcctcccaggttcaagcgattctcctgcctcagcctcccgagtagctgggattacaggtgcccaccactgcgcccggctaatttttgtatttttagtagagacagggttttgccatgttggccaggctgatttcgaactcctgacctcaggtgatccacccactttggcctcccaaagtgctgggattacaggcgtgagccactgcgcctagcctcttttcacctcttaatagcgtcctttgatgcaaaaaagtttttacattttgatgaagtcttatttgtcattttccttttattgcttgtacttttggtcaccagccaagaaaccactaccaattctaatgaccataagactttccctcagtattttcttttaagagttttacaggtttaactcttaagattagttctttaaggcattctgacttaatttttgaaaagggtgtaatggaagggcataaattttgtccagcatcattcttttgcatgtggatatccaggtttccagcaccatttgttgatgcaccatctgttgcagtggggctgacacatttgtaagatgcaatgagcacgaatacatgggagcaccatgaatttatttacatgtctttacttcacagttgttttgaggaggctttcactgagaaacctaacagaaatgaatacatatgacttcctataaaatgaaatttaagtaaaattatactttttaaaatgttaagactggagcaagactggaacatcaccagacaaacagaaacataggctgaaatgaagggtttatgtttatcttgctacaaattctgttggcccacaatctcttatgcttattgcataagagagccacagagtggggtgatagctcaaataaccagtccctggttttctgcttcagaaacaagtttaaattctctgcttagacaaagtaaagaaaataattgaaagatgttgaatgtgaagttggcatctacaaagtcaaagaagtgagtagtaaatgtaaacatcaggaatccaaggagattctatctttttacacagaaatggcctcactatgcactgctgaagggagaaggtccctccaggagaacttcatgatgaggaaaaacccaatatgatgtaggggttttctgctgcagccctaaattgaattgtccttcgctctaaatacaggtctcacaaagttttatgtcttcaatgatttcacctgggccgagattttgttttgtttttggtgttgtttgttttgagctgctgcctggggcttagaaaagtgacttggatattttgccaaagttgtatttctttgatggaattcgaaatccatgaacactctgctttcctgctgtattcccagagcgggttgagtaccttgcacttcttttcagcacttccctagaagtggtagaagatttggagttagggcctccctcaatctctgccctttctttaattcagaggatcacaaactgttgggggaagagtggtatcttgggcccccagttgatcggatgaatattaatatccaatgtcctgtaatgaagtcatgtgtgcatgtaacatcacttctgcacgcagtgtcatgggaaagtgggttcgcggaccccaggttaaaagcctaagcactaaatgcacagagctagagctctaggaggggcgggatggctggggtggaacgtcatcttgtcctttagtcctggggcattttcactcctcacatggtgggtgctgggcatctggcaggtactgatgttgatggagtcgagggagggtactggccggaactgggaaaaacagggttggggagataattaaggtgaacattattttttctgagtgtaagtcatggcttgaaatctggagagcctgaaggagatcccgctacctaaacccgttttccttttccctcaagcctcatttggccacaggcccagtgtcaacaccagggggcgccacagaccatgaaggcaccgcgcagctgggattgtttgtggtgggctcctgggtccctgacttaaccagggaagccaagaccctgcagccaggtggcctggattcaaccttcagctctggtcctactgacacttttcttcctggtgcctcagtttcttaatctgtgaaatggtgaggacattacagcacttacctctcgggcgggtttctcaacagcagccctattaagaatttgagacagagaatcccttgtggtctgtcctgtgcattgtgggaggtttgccagcagcaccccactcaccccctcccaccaatccccacgtgacaaccgaaaatgtcccaggatttttaggtctcccttgggtctagagctgcatttagtcaagcattttcccacctgacatttgagctcatctctgctttggtccacataaggccactttaaaaagatgttgtttctttaaagattctaaccatcttttaaacaaatctattttcttcctttatttctgcattcagttaatccttccaaacccttggtttagtatatctcaaaatgtatcaactccagttctagtaattaacatatgtgacttgcatgatatctgctatgacccctagtagagttctgattcctttagcacagggaatgtgttctcgattctgctctggatgatgtaaatcaatttattttactttacttgtctgggatgttgctcctcacctgtaaaatgtaaatgtggatatggcttggattactaagtggttttatttcttcattcacctgacatttgttgtgtacctgctgcaagtcaaatacatggtatgatattgtttccttgttcacaccacagcaaatgagaaaatgagacattatagccaggtgtggcggcacaggcttctcgtcctagctactcagaaggctgaggcaggagaattgcttcagcccaggagtttgaggttacagtaaggtctgatatcaccattgcatttcaacctgggcaacagaccctgtctctgaaaaaaaggaaaaagacactgtgagctgtctacatgtactctatgtctcaggagactcatgtgctgtaatttttctaaatggcatctccatgtggtctttcatgaatgtttgtctggtatttcttttctatctttttactttcaacttttctgtaccttctactgaaattatggcttttgtaaatagcctacggttatttatttatttacttatttatttttatccctctgcactatttgtcttgtaattggagtgtctgagtccattacgtttaatgtcattgttgacctcattgggtttaagtctgtccattttcatttactgccttctaatattatctttcttgctcaactatttttcttctgttgccttctttagatgaataaaaaactttgcattattgtggtcttctcagtaagtgttctagttacaaattctcttattatttctttaattatctgagaaagcacaataatctgtgacttattataaccaacagcagaccataacttccctgactttcacctacctgtgcagacagcacaggggagaatcaatgctctggctctgagacacaggggtggtggaagtaggatagtgattggatgatgaatctgtagctgcagaggcatctgggcccctcaccttcattcctcgtagatgtcacctccactggatgcctgcaatgccctctcctctgtatgctcctgccagagtctccccatctccattgacagcagctccacccttctgctcactcagtccaatactgtgggtgtccttgattcttctttctcacaccacagataaatccattagcaagtgctgtgaattcatccagaatcccatcacttcccactatttcccctgctcacaccccagtcaaggtaagcgacgtctccatcctggaatactgcactcctttcccaccgtttttcccactgcctcactagtcccccacctctcaattctgttctcagcacagcagccagagagaagctttcaaaggataagtcctaccatgtcccactttccaaaactgtcctctaactccccatgtcattcagagcaaaggtcaacatccttcccacaccctccagggcaacctgctctgggcacacctctgacttcatttcagtttctctctgttcaacacttctggcctcttcctccttccaggaacacagacaatttcctgccctagtgcatctgcactgaaggtttccctgcctgaaaagaactttctgagacatccgtgtagacaactcctcacatccctcaaatctttactccaaggtcacatttgcaacaaggcccatgctgaccacccagcacaacagccacctccctgtacccacagcccaccctctggatcacctgccacacagcacttgccaccttctaactcaagcattttctgttcctactctgcttatactatatcatctgcctgcagaggtgtccaatcttttggcttccctgggtcacataggaagaagaattgtcttgagccacacaaaaaatacactaatgacagctgatgagcagaaaaaaatagaaaaaagaaaaaaaatgcatggataattttcatgatatctgccactacagataagcaaaaaaatcgtcacattctaaagctgtcctgggccacatgcatcccgagagctgcaggttggacaagcttgcatctagaatgtatacacgacaaggccagaaatttttctgtttttactttaacgatgttttctaaatgcaaaaacagtcaaatacctagcagacaacaaatgccacttgaatggatgattactgtagtgcgcccccctattctaaaggcaatatctttattaatgtagactcaggccaaatgtcattttgtagccgctgtggaacaatattatctcatgtggatataaatgcaccagtgcttttctcaccagggctgcttttgtgtcctccctccctccctcctcccacaccaatcctcctgcacactgcagcacacaaccatatttgtctcttgaggaaagataacccaaggcttatggctccaattatccaaccacatatgaatctaaattagactctgctttacaaatccatgagtttggtttggagccagcaataggattactacaactcagggcaggaagaagagtaggagagagagcagaagaggagttccaacagaaagtaaactacaatgaaaaactctgggacctctcctctcgggaagtttcagaatctgcttcctttaagaaggttggggaagccaggcatggtggctcacacctgtaatcccagcactttgggaggcagaggcgggcagatcacaaggtcaggagatcaagaccatcctggctaacatggtgaaatcccgtctttactaaaaatacaaaaaattagctgggtattgtggcatgtgcctgtactcccagttactagggaggctgagacaggagaattgcttgaacccgggaggtggaggttgcaatgagttgagattgcaccactgcactccagcctgagtgaggctccatctaaaaaaaaaaaaaaaaaaaaagatggaaaatacaattgaaagagacctggaaggaggggaagaggtgtaggggtctgaaaatttttcttctgataacacaggaacttctacgtgtagggaccatcctaggtgatatccaagtctatgtgatcacaggtcctggtgggacaaggttctactgaagggccaaggacaatggagcagcaaagatgacccagctgagcagtgaccacataaagttcatggtggcctgagcacccactgggcgcagccccatctactctcctctcctgcaacaaatcagcacaagaaacacgtgtactgtggaaagttctcatgtcttccatttattttgtctctcaaatttcaggaatcttctcctttaattaacccatcaatctctcttggaaataatttgaaaaagtaaatttatactcagattctaattttaatacagaagtaagttatagctcagtggaccacaaatttgagacagagacggagacatcccagccccttttctggaacaggaaaggtgattggggaaggaatgcagttcagcatgaggaagagggtcatggtgggcacaggggtgggctggtctctgcacaaagaggagtcagggttcttgaagtcacaaagggacttgccactcagtcccacacagggcagctgtttcacactacagaaaaatattcatgaacaaattcatatcagtcacagtgaggggtgacactttaaacagcccatcacatgctcaatacattgaagtcaaagaaacctcatagcacagctatgtcccctgttcccctcaacaacccacacacatcaggccccccggggtgtcacatttacaagccgtgagagacacattagagccctgggcactgtcactgcctagagtagaacaaaaacagcacctggtcagagaccacaggagatgtggccagaggaggaattgtggggtgggtgagctcccccatgggctcccaaacacaagatcccaaggatctcagggatcagcctccttcatacttacttgcagcctgagagtagctccctccttttcaatctgtgggaagaaaatgtcctgtgagaggccagaaaggtggcagggccatgaggtcctagaggaacctcctagtcttggaccctcgagaagtttccagaaatgtgtgactgcagacccagggcgggatcaggaaaaacaaggaaagcagatgtgggtcctcgaccaactgccctcctaaggtctgtccttagccagggaccttctcctgacctgtgattactgggatcaggtccccatcactacaatcatcaaggtaataaatctgtccttcattgtcacaggtgctttacaaaagagaaggtgctggcacacagggcccaggctgggtaggcccatgagtgtggatggtgcttcccagtaaccaggcagggcacacttctacctggggcttgaaacccccagtgggacaagaaaactcagaccccacttgtcaccccttccttacctgagctcttctttctccacagcacagcagcgaccgcagctccagtgactacagctgcaaggacaaccaggccagcaacgatacccatgatggggatggtgggcagggaagactgctctgggaaaggaggtgaaggtgagggtctctgacccccagccctcaccaccgaccctgttaaaggtcttcagagaggctcctgctttccctaacagacatgatgcctccatctccctccttactccatctcagcatgaggggctccggcagcccctcatgctgcacatggcacgtgtatctctgctcctctccagaaggcaccaccacagctgcccacttctggaaggttccatcccctgcaggcctggtctccacgagctccacgtcctgggtctggtcctccccatcccgctgccaggtcagtatgatctccgcagggtagaagcccagggcccagcacctcagggtggcctcatagtcaaagacagggtggtgggtcacgtgtgtcttgggggggtctgaaaggaagagtcagaaaattcaagcactttgcatctctcatgggacactccagcagcacctggatgtgaccatcctaagaatgaaccagatacctggggtggggaagggagcacagaacccagacaccagcctggacacgggcacctgggataatctcctattccttggaaagttctagtctctgagcgggggagcagggacctccggttctgacctgagtggaggccaagggactcagaggagctggagtcagacccccacacacattgagtgtgaggcagagaacaaggcctgaggggaaaagtcctggtgccaaggctgctgtggggtcaaagggaacccctgatcagtcttccagggattgtcttcccctccactccctcagagacttcatcccttaattgtcccagagagcaggacggaccctcagaatcactctctggtacaggatctggaaacccaggaggattcctctccctcaggaccagagggagggcgatattctagtgttggtcccattttcctcctctccttgtgctaggccaggctgagaggtctacaggagatcagggaggcgccccactgcccctggtacccgcgcgctgcagcatctccttcccgttctccaggtatctgtggagccactccacgcacgtgccctccaggtaggctctcctttgttcagccacattggccgcctcacacttgcgcttggagatctgagccgcagtgtccgctgcggtccaggagcgcaggtcctcgttcagggcgaggtaatccttgccatcgtaggcatactgttcatacccgcggaggaggcgtccgtcggaccccaggtcgcagccaatcatccactggagggtgtgagaacctggccccaccccctcggtcagccccgcccaccgagcctcgccctcgcccggacccacccgcggggattttggtaaaggcgccttggggttctcccaggtagagggtctgggcgggtcccgcggcctcggggtggatcccagacccggagactcgggagtacccgggccgtccgtggggcatggaggtgggggtcgtgatctgctccctgggccggagttactcactggcctcgctctggttgtagtagccgcgcagggtctgcaggttcattctgtcagtctgtgcgtgggccttggtgttccgtgtctcctcttcccaatactccggcccctcctgctccacccacggcgcccgcggctccatcctcggacacgccgagtcgctgtcgaaccgcacgaactgcgtgtcgtccacgtagcccatggcgatgaagcggggctccccgcggccgggccgggacacggcggcgctgaaatacctcatggagtgggagcctgggggcgaggaggggttgagacccgcccgaccctcctcccggcgcggctgccgagtcctgcgcccccgccgggccggcccctccctcctccgcgcaggggctgtttccctcctgaccccgcactcacccgcccaggtctcggtcagggtcagggcccccgagagcagcaggaagagggttcggggcgccatgaccaccatccttggcgtctggggagaatgagtccgggtgggtgagcgaggactttagaaccaggaccgcggcgacgctgattggcttctctaaaaacctgtcacctaatgggagtgagaactggggccgcccggtgagtatccaggaagaaggacccgacacaggttaggagaaggaggagagaatccccaacgcggggcctccccaacccatacaccgcctgtggggcctgagaccctgagagccacgcttgaggccctgggacttcgccctgaccccgctactcttgtgccaagcgttctgtctcagtgtctccctgagtcttggcccaggagctgtctgagaaaccagggagaaaccctcggcaaggtccctggccctctcccttcacttttcatcccggaatccctgtccctgaactggactccctgcctcccactccttgcctgtcctcctgtactcttctagaagaaaaatcaccccagggagcttgttgccagagagtgagctcgccctgggattgtaggtgtaaagacagggttttttttcccccttaaatctggaaaagttgtgcctgagtgcatgagatagaatagagaccagtttgctttttgtttattaactatagtgggtagcataaccttggtaacccctgaatgatcaggaatctaatcggtaaaaaatgtgactttggcctgttggtatataaatgcatctaaaagcattacaacacgactcacaaagctcttaagtttcactttcccagacagtgtatctgtgactcccgcttgttttattttaaatttaccttcattccgtagccctaagtttccgtgtgagtccaggacatctcctcaagacaaagtaccacactatgttactatatgttgcaaccaggagccagcacaaactttattcacctcacagttgtaagtgttcagtgcagtcacaatgcccctcactagtgctcacgcactgcctgtttttaggaagtatccacatgtgagtggagtgtatattttttaggaatacttagtattttttaaacctgattaacataaaaaacaattagtttctaggcagacccacataagatattaaaggccaactgcaaagaacacccagcgaggctctgtagatggatgtattaaaatctataaaacaatgtgtttaaacctaagagttctgctgctttggaattctttcctctgctccttttcctcacctcctgctcctccagcccttccctccgtccctctcatccctcaggccctcttctccccttaatccccaccaccctctcactcctgaactgtggctctagcactgttccatgacctgctacatgagtgttctctctatagtggtcctgctactatgagtcagagtgtgtcatttctccacctaaaacactccagtggctccacctcattcttgtgaagcttctagaatgtcaggcacttgagcatatgagggcatacctggttcattgtagggactaaattattttttcttggctgaatgaatgaattatgagtgtattaaattgcatcacagaaaattataaaatgtaaaacactaaaaaagttaaaaaagattttattttatgtaactagtgtgcgtatcaattcatcagttcattccaggagtcttttgagtctgtgtatgaattttataagactgggtaacaaattgtcacaaacattggctttaaacagcacccatttattgtattcattgatttatttttagagacagagtctccctctgtcatccaggatgaagtgcagtcacatgatcatggctcactgcagcctcaaattcctgggctcaagggaccctcctacctcagtcttcagagtagctaggactgcaggcaagtgccaccatgcccagctaattaaaaagaaatgtagagacgagtgtctcactatattatcctagctggtctcaaagtcctggctgcaagtgttcctcctgtgtcagctcctcaaatgttaggatacaggtgtgcactaccacgcctggccaaataacactcatttgttgtttatagtttcttaatcagaaatctgggcatgatgtggatggaatctctgttccggtcttcctaaacctgtgttttcattttgaatcctccttcaggcttatacagaggtggcagaatgcagtttctggcagttgtaagactgaggtccctgttcctcactggctgtcactgtagagaacagggagggctgcactcaatgcatggtgcccaccagcgtcctttcctacacagccccttcattttcaaagcccacagtggaggaaaccccttatgctgaatccctctcacactgtgaatctctatgctcaggaagaacccagtcctttcaaggactctccttattaggacagtccaagcaggataaactcagcctaaagtcaactaattgaggcccttaattatatctgctaaatcccttcacagcagcacctacattagagttggttgaataactgggggaaggtgaatgaccaggagctggttgttgggagccatgatagaatcagcccaggaagggctggatcttccttttgtgtttaatttggacacagttggaaattgaagttcaagtaaagtgatcattgtgaatagtaataaaatacatcctcttcagccgtggaaattctcctttccttttaaaactaagttacatgtttaatatcttatagttaatttagaccaggtgtggtggctcacgcctgcaatcctagcactgttgaaggcagaggaaggcagatttgactccagaagttcaagatcagcctgggcaacatggtgaaacccccatctctacaaaaaaattagaaaattagccaggcatgttaattcatgcctatagtcccagctactcaagaggctgagatcagaggatcccttgagcccaggaggtcgacactgcagtgcatggtgatcatgccactgcactccagcctgggtgacagagcaagaccctgtctcaaaaatagtaatatgatgatgataaatttagagcaaatgcaaattaatgtgtaataatacatcctctcttgtgaaaatgtattagttatttactattgtgtaacaaattatgtaaaacttagcagctcaaaacaacaaatattcatcatctcccacagtttctaatggtcaggaatccaggagcggttttcctgagtgcttctggctcagggcctctcacaaggttgcagtccagttgtcagcctagggctgcatcgtctgagggcttcactggggctagggattcatgtgaaacatggcttagtcacatggctgttggaaaagcctagttccttgctgtctggtcccagggggcctcagttcttagccacatggaccttcctgcagggctgcttatggcacagcagctgggtccccaagagctcatgatcccagagacagagagagagaaggtggaagccatagtgagtttcacattctacacccagagtcacaaactgttatgtcaacattactctatcagttagaagttgtattagtctgttctcacactgctataaagaaatacctgagactgggtaatttataaaggcaagaggtttagttgactcacagttgtgcatggctgaggaggctgccccaggaaacttacaatcatggcagaaggggaagcaaacatgtcattcttcacatggtggcaggagagaaaaatgcagagtgaagtggggaaaatccccttatatggtacatatacaccatggaatattatgcagccataaaaaggaatgagatcaagtcctttgcagggatatggatgaagctggaagccattatcctcagcaagctaacacaggaacaggaaaccaaacaccacatgttctcacttgtaactgggagctgagcaatgagaacacatggacacagggagaggaacatcacacactggagcctattatgggagggcagtgctgaggggagcattaggaaaaataggttcaaccgctgacttccacagcttgggggaatcatccccatgattcgatcacctcccatgaagtccctccgccaatatgtggggattagaattcgcatgacaattcaaaatgagatttgggtgggaacacagagacaggccatatcagaagtgcatcattaagtccaagccacacttaagagagggaattaagctgcacctctgaaagagagctgtactaaaggacttacgtatatgttaaaagcaaaattaaaactattgtttcaggattttgtaaatcaaagacttcttttatctaattatttttctttaatgctttaagcttatcttttaatttaatttaatttaatttaattttaagttccagggtacgtgtgcaggatgtgcaggtttgttacataggtaatcgtgtgccatggtggttggctgtacctatcaacccatcacctaggtgttaaccctggcattcattagctatttttcctaatgatccccccatcactgccctccccgaacaggccccattgtgtgtttttcctctccctggttccatgtattctcattgctcagttcccaattataagtgagaacatgcggtgtttggttttctgttcctgtgtgagtttgctgaggataatggcttccagcttcattcgtatctctgcaaaggacttgatctcattcctttttatggttgcataatattccgtggtgtatatgtaccatattttctttatccagttcctcatttgtgggcatttgggttgattccatgtctttgctattgtgaatagtgctgcaatgaacatacacatgcatatacctttataatagaatgatttatattcctttgggtatataacctttaatgggattgctgggtcaaatggtatttctggttctaaatctttgaggaattgccacactgtcttccacaatggttgaaccaatttacatttccaccaacagtgtaaaagccttcctatttctctgcaaccttgccagcatctgttgtttcttgacttttaataattgccattctgactggcatgagatggtatctcattgtagtattgatttgcatttttctaatgatcagtgatgtttagctttttttcttatgtttattggccacatgtatgtcttcttttgagaagtgtctgtttaggtcctttgtccactttttaatgaagctttttttttggtgtaaatttgcttaagttctttgtagcttctgaatatgagacctttgtcaggtggacagactgcaaaaattttctcccattctgtaggatgtctgttcactctgataatagtttctttcactctacagaagctcttttgtttaattagatcccatttgtcaatttttgcttttgtggcagttgcttttggcattttcatcataaaatctttgcccatccctatgtcctgattggtattgcctagattttcttccagggtttttatagttttgggatttacatttaagtctttaatccatcttaagttaatttttgggcaaggtgtaaggaaggagtccagtttcaattttctgcagattgctagccagttctcccagcaccatttgttaaatagggaatcctttgcccattgcttatttttgtcgggctcattgaagatcacagggttttagatgtgtggtcttatttctgagttctctattctgttccattggtctatgtgcctgtttttgtaccagtaccttgctgtttcagttactgtagccttgtagtatagttttaagtcaggtagcctcatgcctccagctttgttctttttgcttaggattcttctggctataggagctcttttttggatccatatgaattttaaaatagtttttttctaattctatgataagcttcactttttaaattaatgactaaaagtttgagacatcacagagccttaggtgttgaggggaaaacagtttgaggcagagaaaggagatacaacagtatctctgagtttttcttgccaatatctttaataacagcaatgttctcttcaatgagttaacacagttgagaacatagaataactagatcaaatagttccaagactttagtgctataaaaataatgccttgaaaataagtctttgttttgtctaaaatgtctcaaatttaggggaagtatgcccctagtgccagttttcttattgaaatatcgtcttccaaaaaacatttgcctacacttaaaaaaagaagtactgctctgtctctggagtagccatcctttgtttctttctctaattaacttgctttcacttagaaaaatattgcttaatcagattgcttttcatttacaaagatgtgaatctcatacttcagtcaacacatctagcatgccaataacttcggtttgatgcagtatcacgaaattgttagctcgaattgagaaactagttttttcaataactggctattcgatcagcattctataatacacttaacatcttttgttgtgatattgaatgatatgtgatagaagtgatttggacaccactatgattctaaatagcatgccatcaggtgcttctgaagtggttttgtttgtttctttgttttcgcagtcctattgtgttttctattcatattgctattccgtcactggttattcctttctactcttttcttgtttcatttattttgatcaatgatgtgcatttccaattctgtaaaagtttaattcagtggtatgtgtggtagaatgtaacatcaaatcctttgcaagatggaattaccttgcacatcagattgaagattgtatacatgaaaatctacagagatgccagtgagccaaggatcaaatgacctatttgtagccaaagccgttttcatggcctcgtggtcctctctgtcacatggctccttacaattctgtgtggttttgttccaatgtaagtagttcttgttaaggatgcttgcaatgaactttggtattcttttctctttcatttttataaaaaccaagcatattttactttgaaaaaatctgtttaaggaattaggaatttaagtcaattctttcaactcaatgttttcagaacacatcatcaacatcaagtattacacatttattttaaaagttccattttaaaagggaatggatgatatgttgtttggactttagccagcactgttgtaaaacacagaacctgtaaactaccctgggctgctgcccattcacatcccccaaaaggagactccatcctgagtcttgtgattattattcctttatttagatgtgtggtcttatttctgagttctctgttctgttccattggtctatgtgcctgtttttgtaccagtaccttgctgttttcataatatctataaagaaattatagagtttctttaaggatttgtgtaataagtatagatatatccccaatccaaatattagttagttttgatggtttttaagcttccagtacagcaaattcctactgcatttattttcccatgatgcacattacatataggagttatctgtggtgtgggaggctgtcattcattcgtttttactgctgaaggtttacattttatggttataccataattgcactagttttctattgatatatatgtagctgattccagttcttgccataaacattagtgtgcatgtctcctgggcacataggcaagaaagcccgcagagtgtatgattaggagtgggatgattggatgatatgttatatggcctttaaccatactagataataataatatgatttccaaagtgattgtgccaacttaaacttatttatttatttatttatttatttatttatttatttatttatttttgagacgaagtcttgctctgttgcccaggctgaactgcagtggtgctatcttggctgattgcaacttccacctcccagttcaagcaattctcctgcctcagcctcccgagtagttgggattacaggcatgcaccaccacgcccagctaatttttgtatttttagtagagtcggggtattggaggccgaaagaatgagggtcgtgatcaactcagtataccactggaggctatatgagcaaacagcaaactgttctcatgaaagcaggatgttggcaaactgacaaactgagtttgctgccagaaggaatcactagaagcaagaagcccccgaccccttcttttagaacagatctttttgtctttgtctttatttctgtgttcatcccccttcattatatcccatagtaaccgattgcgacaatggggttttaccatgttagccagactggtcttgaactcctgacctcaggtggtccacccacctcagcctcccaaagtgctgggattacaggcgtgaaccaccacgcctggcttaaacttttgaaataagtgcgtaatacttgatgttgatgatgtgttctgaaaacactgagttgaaggaattgagttgaaagccgctgtcttggctgcagaattatagcaggcatttttatttagattctgtcaataactttctgttgtttacttgtttctcatataccgtggcattgtacttttggcatacagattcagaaaatgcttacttatagcacaatcacatagggttattttatatgttaggaaattttcataataaaaaggaaaaaatggaggaagggagggaaagaaggaggaagagaagaaggagtgaaagaagaaaagaaggaaggggaaggggaagaaaagggaaggaaagcagagtaaaaaggagggaaggcgagaggttgaatggaaatagagaagaaagagagggagggagggacagaaggaaggagaaagggaaggaacaaaaaagaaaagaaactaaaataaagaaaagaatacacgttgagaaactagaaaccctacgtatggccaatattatgaaaatggaaggaaataaagcagatgtacgtaacctgtatagaataatggaaatgtaagagggcttcattagttatccattgctgcataacaaactacccccaaatttagtgattaaatcaacaaacattgacgaactcaaaaacataatacaaataccagcaaaatggagccaacgcaagtagaagaagttgaataaacaaaaggattttacaaattggaataagaggacactggtgtgtagatgaaaatgattttgtagtccaaatcctccaaaaagcaagtgccatcatggggttaaagttacagcattttattaggggacatacctgtcagacgatattgtgagggagtcaggttaccctgggaaaggcaacaggccgagatgcaagtgtgacccccagtgatggacagaaggagagaaggtttactggatgtttcctagaccacaggcaatctaaggagagttgagcaaggccatggaggagacccggagccaccattggccatcagaggagtcccctgtctcccaggaatgtcctgccttagtgtcactggtgtgagccatcactgactgggaacagcccatgggaagcagggcctccataccaatgctactgaggatgtcagagcacaggagcagggccttgggagattacccaggagtgtgactcaaacctgctgcccagatgggtctgggttcttggaaatcaaatcctctcaggctaaattgctggatgattctgctcacacttacaatggggcaaggggacccagaaggttcccaggtggatgtctggtttccacacacacttctgccctcattgtgtgaaagcagccatgcctcctcctggggatgagggcctattacctgggcctggagagaaggacactcctcttctcacgatgtggtctctgggaacatgctctccaaacttctctggtgactaaagtaatgtgtagttcaatgggctctcttttgtctacttttaagggtaccctcctttggaaaccaggacctcctaacccgcacagcccattgttgggagataaaaaaggcaaaataccttagtggatgaatctaagagattggacatggagccatacctgcttccaccttttgatttctggacctacatgttcttccattgagaacacagcaccatagagacatctctgattcaaacaatgtaccatgttctgaaagatggcactttcagagtgcttcctccaggctggcactgagttgtgcctatagaagacctgtccagcattccttgtggctggtagctcctgggtggtgcagatggtgataggattagtggaacccacagccatggaaactttaaaactttccaggccaaatgggtccttcaggcagagaatgggctaggagcaccgcctagcctgcagatcaggaatgtcaacagcacccggagagtggtgctggctgagtgtcagagcaagacaggaaaacccacccatggaatatgggcctatttctgtgaagatgaacctctggcccttccaggatggaagtagctaaatgtagtcacttgttacttagtggctggtcgcctaaagaaatagcgccccactagggcacatcatgggctccaaatgctgacgagttgacattcaggagtggcagtagctggatctaccttggtagggctgggagagtcagtgctgctggcctcatacatagcctcatgcctgccactgtggttgctccattcatgcacccatcctaccaggcctgggctgacccatggtgaaggctggctaactgccatttgtctgtttggtagttcagtgccacttcagacttgggtgttttctgtgggtgtcagcaagggattcaagctcaacccaggtggaccattttcacctgttgatgaatgctgttgggcctgtgcaatttatgactttgtgggtcacacagccacttggaaccacattgttgtttggtgtcccatggtcaagcattctatcaaatcaggacaagtaacactaaatgttgcttctaacagggggcatatgtctctgctgtggatgacatgatcttactccagaatcccaggcccttcattgtgactctcccactggtgcttggttcagctccatcctgcatctttccccaccactggcaccaccagccccaaggggtctgagggatgctggctgcttgtaccatggcctggatctgctgcaaggtcctttcctgtgtgggccccacatgaaggtggcctcctcctatgtcacctagagtgtgggccaaagcaacacacctaaatgtggaatgtggtgtcatcagaactcaaagaggctcatcaggcagtgtgcttccttccttctggtgaggatgcaagatgaaacagtttgtcttttaccttggaggggacacacctgcattcccctaaacacttggcacttgttcacccataaaacttcacttcagtggccactcttgaagctctgtaaggtttaccttcaccttctggagtgtgcttgttttgccaaggactccagtgcagtttctacctgctgctcatccaccccagtaaacatgaaattgtcaatgaaatgagctgatttaatatcctataggatatccagtatgtctagtgtagtcttaagactatatactatagcgggcagaggagttacaatagccctgaggcaaatgataaataaatgtgttgtggatcccacatgaatgtgaatcattccatatcccctttctaattggagtggaaaggaatgcactcaccaagtctgcagctgcacactgtgggcccaaggatttattaatctgctctaccagtgatatccagacaacataaaagctgcaattataactcctacttggccatacctagagtaatctcattcattctttaggcatcatcaggctccctcagggacagtttgctggattacgtagagacgatagacagccccaacaccaccccacatccttcagctctctcatggtgatgtgacccccacagtactttcagtgccttccacaagacacatgaggttgcctggttgctgtggtgcccgctttccaccccaccctcccgtacccccatgtcactttcattgtgtcctgaataacagtttcaagtttgtctatggcttctgcgaggagccaggacatccagatagaatgggccacatgaatcaattggtacgtgtttctcctttcaggcagagtctcactcacttcacacaagcacagagatccccatataggcaactagattatgagaaacaaacgcacccatccaaacccaaagaatggactctgagacccagagaacagcaaaagtgagagtgttagtgacggttttgcaatattgggtgtctggaatgcaggcacaccagggagagtttcaacaatttattccctagtgcgcaactccctcccccagttgctcattagctgagtaccaaggacttacgatcttcccggatgtcacctattggtagtttaagacttcaagtatgttccttagggttttgtttttttttttgctgcattttgttgcagcccataatgcattgtgattgtctcaggactctttaaacatttgacttatgtccctaatggctgcacttagttgataagaaagggtacaattatctatgttgcaagctagcctaaactacattttttggtgaggtggggaaggggtcgttgagggggccccaaccgataggtgcctggccagtgcatgaaagggaaagcaagaagtaggggggatggtggcttagtacattttccttctttatctctttatgaccatgtggcctgcttaaacctatactaaggcacatagaattgaaaatgaaccatcacatgtaggttattttttacacccttaagtcctgcccaagccagggctgggccaaggccctcgaacatccagctgtggcctcctcctgctgcaggtgaggagtgggcagcagggagggccgtggtgcctgctttgtccccatcccggtctctgtctctcaggcttaccaggtcgcatccaggtgggtgagttgggaattgcgtgctgattgctgagggcctggatgatcactatctcagagggagcaaatagtaaaggcagatgtgatctagggagggctagaaactggagaggaatccaaggagaggtggtgcctctagtcccttcctctctgcatccccctcccctgtttctccagccatcaggaggacatcaagaaaaagacccacgaggcccagaatgagggcccccatgtgtacagcccctttgaggtccccttgtaacagggagagtcctgagtgcacatggccatcctctgtccactttgcagctccccatatgcctcatctgggagctgtctcaggggtgtcacgtcctctgggtccctcgagaccgtgctttttctgggttcccaccatatggcccctgtctccctgtgtttccttgcagataatatggaccagttgataagcagatgtccctgggctatttggggagtggggaccagccctctgtcagggcagctgtggtccctgttttcatcccatgtccaggtgttactttttccagcccccgagggtcatagtacccagtgggctgttttttgggctttgttctgtgctctgtggcctcaccttgcctttcctgagccaatgtttttgttcttagtgtagtcgctgcctggtaagtttacaataagagacagtcagaatcatttcccccacagtcaggttgtttgaggggagaggaaaagagcaagcagaaagttttgagtttctgcaaagacagaggcagtgcaggggacagtgagagtctggggtgtccaggaaacccgagtctttctgccatttctccacttccgtgtgtctggccagtgaggtggtggtgactcatccttgaacctaattgcacagttagttggccactcaggcctgggcagatgggacggttcatcccctgccctgcagcaagagggccccgtccaggaggcaaccacagcacgggcagtgcaggtctgtggttgctcctgctctcacctgcggtgtctcctatagagggattgtcagttctggttccctgtaggcaggaaaggttttctcgtaggtcactgggacattggccagaaaaaggcatgaaaattacatgttagtttctcaaaattcctgctttaagtattggtgtccatcaacataatttcagctggataatcttaataggatttcccccaatactgatgttgtaaaggatgttgaatagaacaggaagtcaaatttggggcttcgtttctcagagggtccatgtgggagacagtgcctgtggcagtggcaatccccaggtgcagagggtgcgtagaggcagcctcaggatgaggggtctgaagaaaccccctactccacaggcgaagaagatcccctgtgagctgcgatggcagtggcctgggtggaatccctgttaggaatgggacaggaagggcttgcagcctcaccaagcagcagccctggggtggagctgcatttccagggttgagtggacaggcaggagcaagcacagcccaaatgcaggttatggggagggcaggctgggcctccttgagcaagggggtccccagcatcaggtcaggtgcagactccatggcagccacatatttccatgcagggcctgtgagccccagggcttcctgataggatctctagttaggagctgtctgctcagagctgggaggggaggaacagtgagctgctggtggagggcagaacccacagcgtgcagggcctgccctggtatgcaggtgcctctgcaggtgaagagggcctggggtctcaggaagagaaggactgtgtgtgacttggcccagacctggaaggacatggagacagggccagggcctctctttggggaggcctctcactgtgtcagggctggtcaggcttgagaggaggaggaaagggcactgagtttcctcctgggtcttgttccttagtcctgggtcctttcactcactgcacaatggatggtggacacagggcaggtgctgatgttgatggagtcacgggaggggactggcaggggctggaaaagtgcgatgggagggagaaaaaagtggggacgtcatcttccgtcagagaaagggtaaatctgatttgggagtgactgaggagggagaactcctcagggaataaaaagcagcactctgcacccaggggagcatttattggtttctctcttttttccagagcgcgtgagcctgcaaggcctgggtcaacacctggttgggacaggagaccaccagggcagtgcacagctgagatctcagtctctggtgtcagctcctgggttcgctggctccactgagggcaactagactctgcagccaggcgatctggattcaactccttgcctaggcctcaccagcatgttctctctttgtgcctcattttcctcatctatgacatggggaaactacgagcatttatttcttgtggttggatgaatgaaaagggttagtatatatggggtatttgcagctgtgccatattatttttgttattttgttattttattatattttgatatattacatatgcagtaattgtattattataggtgagcattatgagtgagtgtcctgctgatggctccttggtcctggcccagcaccagctttcctggcaccttgaggtcctgtcatctctgtcatgctctcctgcattaccccattctactctgtcttcatattttatactatagatatttaactcttaaatagacatttctggtctgcgttttatttcaagtgtctgggaagggatagtgtgaggttcaggagagaaggagaggtctgtctccatgctttgacacagcataaagaaaccttccctcctcccccacatctccccgccagttctcagtgagggacagattcacagcaacaccgaaagggctgggaagggatggggggacatttgcagccagtgttcaggggctgaccctgtggggcaacatcttccctgcagagttagagcccacatatgatgatgtagagctgaagggtgatatcagggaggggaaggagagtgctttgtggtttcctgattacgaagagtagaggtcagtcagcttctggggtgaagtgactgctggggagattggattgaattaatgaagaataagtgagctgggattgaggatgagtaaagcaagcatcagcatctcccgccatcagttcagactgactggggaggtgggatagttcctgaccttgttgtgtggttcctcctaacttcctggtcttggggacacagatgggtggtgctgttcttggtcagggcagcctcagctccatccagataaagcagtggtggcagagagagttaggggagcacctgtgaaacagaccaaggcagggatgggagccttctgtgcagccagagtggatgcaggacctgcctggatgcaagagaaggatgagggaccctagctgggtcctgttccctgactccctgtgttcacagggcaaccagtaagggagctggggtagggaattcattcataagctatctatctagagatgtgtttatagacatattatttcatgtttgtattcaggtttgttgtcacagacacatttatccatgtgtgttttatgtttaagttactttggaatagctcagtcacaaaatcttaatctcttaatttgtgctgcctctctacacggaaacacacacacaggtggacacacacacacaggcacacacacacattcacacacatgctatacaaacatgtctacctgtatctataaagaaacatgttatgttattttattttttatttcttagattcatatatattcatgaggcacaagtgcaattttgctacattgctatattggttgtggtaaagtcagggccttcagagcatccagcactggagacaagcacattgtacctatcaagaaacccctctattatacaccaactgccaacccccttacccttctgggtctccatggtccatcatttcacactctccttttatgtatataaagagatattaaccaaatacggcagagtggtagcttgaattttaccgcaccattctttcagcttctttgcacatttgaaaatttatacagttataagttggaagaatgagggaaaatagagagcaagacagtgctgaataggaataggctaggggttgtgtcccactaggaaccataattgatctttgccattttgaaagtgtgtcccctgagcagccttcagagagtcctggaggcagacttgttttcacagtaataccaagatgccatctgcctgtttcattgtgttgacttttccatagtgctgcaaatgccaaggtcggtaacacacccagcaccttagcagaaccaggcagtggctccaaactgcagtcccatttaagagtgtctttgatggagcagtaaaaaatttatgtggattaaagtttgatccttgagtatacgtgtttaatattctttgtgagaaaatgggaaatatgcataaaacacttactgcacagagaagcaggatggtagccttgagaaagggcacttgtgtgactcagttattatttcaaccagcagatctcactcacctacggaaagacagttgtattaattcctgtttgggggtatcatgaataaagctgcaagagtatttgtgcacaggattttcgtgaacataaagtattccctcgtttgaaataagtgcctaggagggcaattgctagtcataaggtaaattgcatgttcggtttgaagaaaactacaatactcatttccagagcggctgtaccattttaaaatacatccctaccagcaatataagagtgtcccagttcctctgcgtccttgccagcatctgttgctacctttattttgtatttcagccattctcatcactgtggttttaatttgtattttcctactggataatgatgttgagcacctattcatctgcttattagcccagtatttatcctcttcagtgaaatgtctgttcatgtcttgctcattgcctgttttgtatttggatttcatttttattgttgagttttaaaatttcttcatatattctgaatacagtctttacagaatatgttgcctgcaaatatcttctctcattctgtagcttgtctttttatgctcttcataggtctctcacagaacaacagtttttagtgttgataagatccaatttattaacttttatggatcatacttttggtgttatgtttaagaactctttgtccagtcttagctctgatgactttttcttaaaaggtttgtaatttaaaaatttaaatttattatttattttagaaaaaaaattattgcctaggctggccttgaactcctgggctcaagggatcctcccacctcagcttcctgagtagctgagagtacaggcctgtgataccacacctggctcaatgtttgccattttaactctgtgctttacatgaaagcttgtgactcattttgagttatttttgtatgaagcatgaggttttggctcaggttattttttttccactgtggttgtccagttgttccatcaccatttgatggaaaagctctccttccttcattgaattgcttttgtgcttttgtaaaagtcagttgagcatgttttgctcatttttagttgagttgctcatcttcttacattgagtttaagaacttttcacatattctggatacatgttcttcatcacagatgtaatttgtgataaattgtgaaatattttctctcaatctacggcttgtcttctcattttctcaatattgtcttttggagcacttaagttttaaattttaactaagcccaatttgtctctcacttttttttcatctgtagatcatgttttttgtattttatgtaagaatcttttgcctaactactcaatgtcacaaaaattttctcctatattttcttttagaaattttatggttttaacttataaattttagctgtttaggtctctaatttgtttgagcttatattttatatggcgataagtgtcacatcatattacctatgcaacttcattgaagatcaattgacaaaaaaatgtaagaatgtctttctagattctcacttctgttcattaatctctgtgtctctcgctttcacactgtctggattattgtagttttatatgacattccattttttttcaaatttgcgttggcttttctgcatcctctgcattttcacatacatttttaggattaaattgtcaattttccataaaatgcctgctggggttttgatagagattgtactgaacctatagatctcttggtggagaattgtcatcttaacaatattattgagctttccaaccgcatctctccatgaatttagacctttaatttctctcagtaatgttttgtagttttcaacaaactctgctgtcttcctaaatttattcctatttctctctttttgtaactactgtgataggaaagtttagattttaattgcttgtatagagaaatatgttaataatttttaatttgattttatatcctatgggagcttctggattcattttttagtgctagcaggcttttatctgcttgtgaattctacagacaaggtcatgttatctgtgaatagagttttatgttttcctttttatctggatgcctttaacttttaattatttgccttattgcaccagctgcaatctccagtacaatgttaagtagaagtgttggattggacatccttgcattgatctccatcttaggagaaaagcattcagtctttcttcagcaagcatgattttagttgtgggttttttatagatgccctttatcagggtgaggaaggtcccctccattcctattttgttgaaacttatgaacatgagtggtgttaacatttttgtcaactgtttcttctgtatcttttgagataattatgtcttttattcccttactacagtgcattccattaattgatttctaattgttaatccagccatatattcctgggatgaatcccattggtcatggaatgtaatccttttttacgtggctttctattgtctgccaatgtttgttaaggatgttttcatttatgtttattggtgacactggtctatggtattcttttcttgtcagtcttgctctgactttgatattagggtaatgtcagttctgtaaatgagctagaaagtcttgcctcctctcttcttgtctgaaagagcttttgaaatatttgatagaattcaccagtgaagatatctgggctttggcatttctttgtgagaaggttttaaaattactgtcttagtgtacagttctcttcagattttctatttatttttgagtcagtttcagcaatttctatctttgtataaatctgtccattttatctaagtggtctaactgattggcttcaggtttttcagagtattaacttataatgttttttaacttctaaagggtcattagtgatactctctcttgtgttcacaattttggtaatttatctcatttctcatactgtctgttttgacttttggtcaagaaaacagacagaggcagctctgtgacagattctgtagtgggaagctttgatcattcatagctggcaagccagactaatgccagcaaccccaaaggagctgccaatggatcttgacagggaagtcactgactctggattgggctatgatcaaccaggggtagatgtcaatgcttcaaaggctatacaagaaccagaaaaatggagattacaccaatttggactgttgagtcacatttctttacacaagaaaacacactttacagccttaaaaagccaacagtgcacagggaaatgtactattcaggggaaactttgatagaatattgaaatggctgaccaggcacggtggctcatgcctgtaatcccagcacttttggtggccgaggcgggcggatcacctgagtttaggagtttgagactatcctggccaatatggtgaaaccccgtctctactgaaaatacaaaaattagctgcgtgtggtggtgggcgcctgtattaccagctactcgggaggctgagacagtagaattgcttgaacctgggaggcagaggttgcatgagccgagatcatactactgcactccagcctgggcgacagagtgagactccatctcaaaaaaaaaaagaaaaagaaatagtcagttgaaacattggttgtctaattgtctaaaaactgccaatataattgttgggcaatataaacatgaaggactggcttttatatcttcatgaatgtgcttactgtcaacatgggtggagctgcgaaactgactccactaggtagcttcctctctttttcctgatggatcagggtgatgctgttatgactgtacatacaattcttcttaaggggaggatgctggaataatgactacacttcatttcttatttctttttttacacagggtgcagtggtaccaggaacagggatgcaaatcgaactgccagaaacaggaattatccctaaggaaaaaaccataactatatttttatacctttatgtaagaattcccaagcaaatcaaggattgcgctgtgccttcatttcatctggcaaagtcgggattaactgtaagtagagctacgtagactggtggtcagatagcctgcactagttcctaacctatgtaacctactgtctatgatcaagagtagattaagagaagacatggtagaatactattgctgcatgcagtctaggccagcacagcagccaaacctaatgtcacttctagaactggaaaagactgatataaagggacagaaggaggaatagtggctgagggtaggtgaataaatcaaagggttatgtaatgaggaaaattcaatattagcttatctcctcaaaagtggtgtgagcaagagatgttgtctcttaggtcaactatactggatgcctaaaagggtgaagctgtatgtccctgagaccattcttgtttttggaacctgataagattgaatggtgtctgcaaagctgagtgatgtcattctgggagacatattcatacaagaggatgataaactggcctaattttgaatgaccgaatgagacttggataatatgccaatgcttctttactgttataatccttttcgtatgaaaaatatgtggtcaaagaaaagggggtaatatgagttatcacaaaaacatttagttttgtccctggtttctcctaaaaaccttagaatctcttgagtgattagagtgtctttagaatactgaggaaaggactcttggctgagaggatcctggataccttgagaatgggggctggctgccacagacacatacctatgatgagagggttgtcttattccgttttgtgttgctataaagaaatgtctgagactgactaatttatataaacaaggttcatttggctcaggattctgatgtctggaaatgtttgagcatttagcgagggcctcaggctgcttccactcatggcagaaggcaaaggggagctggtatgtgcagaagtcacgtggtaagagaggaacagagggagtaggaaggtgcgagactcttttaacaactagctcttttggaaactaatagggcaacaattcattgactcccgagagagggcagtatctctctgttcataaaagattggcccccaagacccaaacgccacccattaggccctaagtccaacattggggatcagattttaacatgaggtatctggggataaatatttatatcattgcatcctgtccctagccagccaaagctcacattcttctcacattgcaaaagacaataatcttctcccaattgtccaaaatgtgttgggttgatccagcatcaactctaaattccaaagtctcatctgagactcaaggtaagttcttatagctgtgcacctgtaaaattaaaaaaagttatttacttctaaaatattaatacaacagtggtagagacatttcctatacatttccattccaaaagaaataagtggaccaaaagaaatgaatgcagtgtcctcacaaggttgaaactcatcatggcagacattaaaacttaaagctctaaaataatctcctttgactctatatcttgaaccctgagcacactggctggtgcaagcaatggactcacaatgccatcttcagcctcatatccgtggctttggtgaacataatccatatagctgctctcatgggtgaacattgaatgcttatggcttttccaggctgagcttgcatattgccagtggctctatgatttagtagtcttggcaggggtcctgttcctgcagctccactaggaattgtcctggatattaaatttcccctttaaatatcagttccagtttcaggtcatgtctttgctcacacatatgtgcataggctattacaagcaggcaggccaaatctggaatgctatgctgcttagaaatttcttccaccagatacccttatacatcactctcaagttcaaagttctacagatccctagggagggggaacaatgcctccaagttatttgccaatgcataacaaaagtgacctttcctctaggtcccaataagttcctcatctccatgtgagaccttatcagcctggactctattgtccatatcactatcagcattttggtcacaacagcttaacaaatctctaggaagttgcaaattttcccccattttcttgtcttctgaactctccaaactcttccaacctctgcctgttacccagttccaaagctgtttccacattttcaagaatttttatagtaatacccaactcctggtaccgattttctgaattagttcattctcacacttttataaagaaatacctgagactgggtaatttataaagaaaataggtttctttctttctcctcccaccatccaagatgccaaaaggaaagaaggccaaggagaagaaggtggctccagcccctgctgtcgtgaagaagcaggaggccaagaaagtggtaaatcccttgtttgagaaaaggcctaagaattttggcactggacaggatatccagcccaaaagagacctcacccactttgtgaaatggccctgctatatcaggttgcagcagcagagaaccatcctctataagtggctgaaagtgcctcctgagattaaccagttcacccaggcaccagacagccaaacagctactctgctgcttaagctggcccacaatacagaccagagacaaaccaagagaagaagcagaggctgttggcccgggccaagaagaaagctgctggcaaaggggacattccccactaagagtccacctgtccttcgagcaggagttaacaccatcgccaccttggtggagaacaagaaagctcagctggtggtgattgcacatgatgtagatcccatcaagctggttgtcttcttgcctgtcctgtgtcataaaatggggtcccttactgcattatcaaagggaaggcaagactgggacatctagtccataggaagacctgcaccactgtcaccttcacacaggttaactcggaagacaaaggtgctttggctaagctggtgggagttctcaggaccaattacaatgacagatacgatgagatccgccatcactggggagacagtgtcctgggtctcaagtatgtggtttgcattgccaagctcaaaaaggcaaagggtaaagaacatgccactaaattgggtgaaatgtatgctgttgagttttctgtatgtaaaaataattaaaataatataaattttccttcaaaaaacaaaaacaaaacaaaaacagaaaagaggtttaaattgggtcatggttctgcaggctatacagaaagtatgattctggcatctgctcatcttatgagagggcctcagggaactttcgattatgctggaaggctaaggggaagcagacattacttacatgcctggagcaggagggagagagagcagggaggtgacacagatttttaaacaccagatcttatgagaattatcacaagaatagcaccaaagagatggttctaaaccgttcatgaaggatccatcctcatgagccgatcacctgccaccagacaccacctccaaaattagggattacaattgaacatgagatttgggtggggacacagatccaaacaatatcaggggtcatggtggacatgaggatgggctggtctcccatttcttacctgttactgtagacatagacacattcagaccctttggcagaaagagaagccagaggctcttaatgtcacaaagaggaggcatgaacaaatcttgcatctcagtccctcacaaggcaatcttagaaaaaacatagtcataaactaatccaggtcagtcatagtaagttgtgacactgaacagcccaccacaccttgaaaaattccaaatcaaagaatctccagagcttagttgtgtcccctctgcccaactcctctttcacttcaggccctctaaggtgtcacttttacaagccttgagagacacatcagagccctgggtactgttcctgtttggggtggaacaaaaacaaaatctggtcagagcccacaggtgatgtgactaaaggaggaattttggggtggctgagctcccccatgggctcctgtctacactatcccaaggatctcagggatcactcttcccacccctaccacacttacatgaagcctgagcataactgcctccttttccatctgtggaaagaaaacaaactgtgagaggccagggaggaggcagggcatgagatcctagaggagtttccagaactgtgactacagacccaggtcaggatcagaaaacccaagggaagaggatgtgttgaggctggaccaattgtcctcctgaggtctgtcctcagcagggaccttcccctgacctgtgactgctgggagtcaggttcccatgaccacaatcaaggtgataaatttgtccttcattttcacaagtgctttacaaaagagtaagcgttgatagacagggcctctgaacagggtaaatgtgtgtggagatggtgcctcacaactaggcaagatatgagcctactcctacctggggcttgaaatccaccaatggaagaaggaaactcagagctcacccctttcctacctgggatcttattcctccacatcacagcagcgactacagctacagtgattacagcaactagaagaaccaggccagcaatgatgcccacaacggggatgatgggctgggaagacagctctaagaaaggaggtgaacgtgaggggccctgacccccaggcctcagccctgaccctgcttaaaggctccagaaggacttctgctttgcctgagaagagacatgacccctcattcgtctccttaccccatcttagtgtgaggggctcaggcaacccctcgtgctgcacatggcatgtgtacctctgcttctctccagaagacaccactgcagctgcccacttctggaaggttctgtaccctgcaagtctggtctccacaaactctgcatcctgaatttggtcctccccatcccgctcctgggtcagtgtgatctccagagggtagaagcccagggcccagcacctcagcgtggcctcatagttggagatggggtggagggttacctgtgccttcaggggatctgagggcaagaggtagaaaattcaggcactttgcattcctcatgagacacagcacccatgtgaccatcctgagaatggatgggacatctggggtggggaagggagcacagaacccagacaacattctggacacaggcacctgggataatctcttattccttggaaagttctagtgtctgaggcggaaacagagatttctggtcctgacctgagtggaggccgagggactcagaagagctggaatcagacccccacacacattgagtatgaggcagagaacaaggcctgagaggaaaattcctggtgcccaaggctgctggggggtcaaagggtaccgcgtatcagtattccagggattgtcttcccctcctttcccgcagagacttcatccgttaattgtcccagagtgcagggcgggccctcagtcactctctggtataggatttagaaacccaggaggactcttctgcctcaggacaagagggagagggatattttagcgttggtcccattttcctccccttcttttggaaggtggctcagggatatctgcaggagatcagggaggcgacccgtggcctctggtacctgcgcattgcagcctctccttctcattcttaaggcctttgctgagccactccgcccaccttcccggcaggtaggttttgagcagctctgcatgttcctcctccaaaacatctgagccgccttttccgctgcggtccaagagagcagttcctggtttaggacgaggtaactggcgccatcgtagggtatgttcatccccgcgcgaagaggctccggtccgggtccaggtcgcagctgtgtatccactggaggtgggagaccctgtccccaagcccgcggtcagcctcagccactgagctcctcctctgccccgatcaatcccccggggatttgggcctgaactgaaaatggaatcgggtataggcacctggggttcttgtgtcgagggtctccacgagtcccgcagcctcggcgtgggtctccgattgtgctacagtgggtagcacaatcttggtagcccctgaatggtcacgaatctaatttgtaaaagagatgatttttggccccattatatataaatatgtctaaacgcattgcaattagactcacaaagtgaagttttactttcccagactgtgtatctgtgactctggtctgttgtatttttacagtatctttatttcatagctctgagtttgtgtgtgcgagtccaggacatctcaatacaaagcacaatgtattaccgtatattgcaaccaggagcctgtacagaatttaattacctcagaattgcaagtgcttaatgcagccaaagtgcccttcgccagtgctcatgcactccctttattattaatttttttattttttatttatttacagacagggcgtcactctgttaccctggctaaagtgcagtggcacgctcatgactcactgaagcctcgacctccttggctcatgtgatcaatgctcctccctcagcctcccaagtagctggcaccacaggcttgtgccaccactcctggctaatttttctaaaaataatatttgtagagatgaggtctccctaaattgctctggctggtcttgaactcctgggctcaagcaatcctcccgcctcagcctcccaaaatgctggtattacaggcatgagctataatggccggcccatgcacttgcctattattatgaattattcacatctaagctatgtgtatattttattgagacatttggtattcttttttaacctttttttttttttttgagacggagtctcgctctgtcgcccaggctggagtgcagtggtgcaatctcgctcactgcaagcaccgcctcccgggttcacgccgttctcctgcctcagcctcccaagtagctgggactacaggcgaccgccaccacgcccggctaatttttttgtaattttttattagagacggggtttcaccatgttagctaggatggtctcgatctcctgaccttgtgatccacgcgcctcggcctcccaaagtgctgggattacaggcgtgagccaccgcgcccggccttttttaacctttttatcttagagaggcaattagcttttagacagccccacagaatgcattaaagaccaaggtgcaagtaacactgtgccaggctttgcggataaatgcattaaaaatctataaaacactgtatttaagtctgagaattccattgctttagaattctttctctctgttcctttacctcacctcctgcttctccagcccttctctctgtccctgtcatccttcaggccctcctctccccttagtctctactactctgtcactactgaattgtgtccctagctctgtccctcgcctgctgcccatgactgttctccccacaaaggtcagcaatcctgctaatgtgagtcagattgtgtcatttcttcacttaaaagcctctaatggctccatcttactctcaagaagcctctagaatggaaggcacaagcacaggggctttgggttgctttgatcaaagttgtatctacagaatataaaagtatatctgccacatagtaggcactaagttaatttttgttgaatgaatgaatgaaatataattgtgttcaaaattgtatcacacaaaaatcatgaaatggaaaatgcaaagcaagttaggaaatatttggttttatgcaactactatgcatatcagttcatgaattcattccggtggagaaaatgtcatatacttatcctttgaatctgtttatttatttcctggcagtacataaccaattaccacaaacttagtggctgaaaacagcacccatttatttgtctacatttccttcatcagaaatccaggcctaatgtgatagactctttgttcagagtttcgcaaagctgtatcctcatcttaagattggggttctcccccaagcttatgtagagtttgttggcagaattcggtttctggcaattgtaggattaaggtccctgtttccttcgggctatcagagtagacagtggggagggcttctaattcctattggccaccagtgttctttccccatgatccctccattttcaaagcccaaagtggaggaagcccctcacgctgaatccctctcacactgtgagtctctattctcaggaagaacccagtccttttcagagcttacctgattaggaccgtctaagcaggataatcctcatcttaaagtcaactgactggggactttaaatatatctgcaaaacctcttcacagcagcacctgctttagtgtcaactgagtaactggggtaacctgagaaaccaagggtggttattggggtgtcatcatagaatcagcctagctagcctggatcttcctttcatgtttaaatagaacatacaagttgaagatcaaaaaatagatcattgttaatgataataaaatatatcttatatagccatggaaatttttattaaatattaaaagcaaatgacatgtttaatatcttataatgaatttagagcaaatgaaaaagttcagtgattcatcctctcttgtgaagctgtattagttatctactgctgcataacaagtcacctacaacttagcagctcaaatcaacaaatatttatcatctcccacagttatccatggtcaggaatccaggagaagtttctctgaatgcttctggctcagggcctctcacaacgttgcagtctagttgtcttccagggctgaatcatctgagggctcaaatggggccggggattcacaagacacaagaatctctcacatggcttttggaagaggctttagcttcttattgtctggtcccaggaggactcacttcctagtcacatggaccacaggcctccttatgacacaacagccagcttcccccagggctcatgattccagagaaagaaagaaccaaagtagaaacttcagtgagtcttatgttctacacccagaatcacaaactattatgtcagcattactctatcagttagaagtgagtcattaagtccaggccacacgaacagggagggaatgaagctgcacttctggaaaggaggagtatcaaagaatttataaacatgttaaaagcaaaattaacattattgtttcagggttttgtaaatcaaatacttcttgtatctgactttttttaatactttaaaattctcttctgtaaagttgattaaatatttgagacagagaaagaagatacaacaatatctcagattttttttgtaaatgcctttaatattaatattctctttgataagttgcaacagagttgagaaaatacagtagctaaattaaagtgtcccaagactttggtgccatacaataatgcctttacaatcataactacgtttgtttctcttcagaagtttctaattcggtttaagaatgcccaaaatgccaattttcttactcaagcatctacaaaaatatttgcctaatcagggtgctttgcagttagaaaaatgtgaatctcacacctctgtctatacactagcttagcatcatgacaataatttgtttggctagggtaggcagaaattgtttactccaatctaggaacaagatttttcaataactggctattcagtgggcatcctatgaaagtttaacatctttcactgtgttttttaattagatgtggtagaagtgatttggactcctgtatgattctgaaaaacactgttcttttgtgctgctatcattgctgtacaagcatctctttcatgttttccattcttattgctatttcatcactagttattcctttatgtcttttcatttaatttattttgctcaacaatgctttttttttttactgtgtaaaagtttaatccacttgtatgtgtggtaaaatgtgagcaacatatcacattctcaaattctttgcaagatacaattgccttgcacatcagattgaacactgtatgccagacaatgtagagagttgccaattagcccagggtcaaatgacctctttctagccaaggctatttttcatgagatcctggtcctctctgtcacatgactctttacaattggctgtggctttgttttaacgtgtgtagttattgctaaggatccttgagatgaactttggtattttcttttctctttcatttccaaataatcagtcaggaatggcacacaaggtgcattttgaaaaatgacactttaaagatttgtgggccgggaatggtggctcatgtctgtaatcccagcactttggaaggccgaagttggcggatcacctgaggtcaggagtttgagaccaacctggacaatatggtgaaaccccgtctctactaaaaatacaaaaattacctgggtgtcgtggtggatgcctataattccagctactcaggaggctgaggtaggagaattgcttgaacctgggaggcggaggttgcagtgaactgagatcatgccactgcactccagcctgggcaacaagagggagactccatctcgaaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagagaaagaaagaaagaaagaaaagaaggaaagaaggaaggaaggaaggaaggaaggaaggaaggaaggaaggaaggaaggaaggaaagaaagaaagaaagatttatgatcaagtaacttaactacctggacatcccctcctggcataaaaaacaaaacctatgaagccaccctcggctgttgtccaattctattccccaaaaggaacttctatcttgagtcttgtatttactattccttttcattgtctctaaagatttttacaataagtatatatatatatatccaaatcacagtttgacctgctttttttaacttccccgtacagagaactcacacaatgtgcattcttctgtgatgctgatgcatgttatgtgtaggagagttatctctgatgtgggagggtgctgttcattcactgttgctgctgaagttttactttttattattatacgactattttgttaattcccattgatgtatatgtgattgtttccagtttttgccataaacattggtgtacatgtctcctggacacatagccaagaatgtccccagggggtatgatcaggaggcagatggtgggattatatgatgtatggacattaatcatactagataaggctaatttgatttctcaagtgcttgtaccaagaatgggaaagagcttgtgttgctcatgtgttctgaaaacattcagttggaggcagaaattaaatgttaaaaggtactgtcttggctatagaatcaccctaggcattttttcatattccattaacaacttccttttctttacttttatattataaattacggcattatacttttagcataaagttcaaataatgcttccttttggcctaaacacttggagtttatgaaaaaaatggagggagggagaaagctctgagggaggaaaggaggaaagaaggaaggaaggacagagaaagacaaaatttaaaatgttcaaaaataggaggaaagagttggaaacagcaagtatagctaatgttattaaaatgcaagggattaaaagatatgtagataatatccatggaataatggaaacttaagaaagccttaatagttatcaagtgctgtgtcacaaactacctcaaaatttagtagcttaatagaacaaatatctgttaactcaaagagatactacacacacaagtaaaatagattctgtgggggtggcagaagttggataaagagaaggattttacaggttggaataagagttattgatatgcagatggaaataatttttagtccaagtccttcaaggagcagatgccaagatgagcttaaagtctgcgacatcttataaggggacacacccgtaagggaatatgggaagtgagccagaaatccctgagaaaaggcggcagaccacgatgcaagtgtgaccccaagtgctggacagaaggagagaaagtttgtttgacgcatcctagagcacaggcaatctaaggagagttgagcaaggccgtggaggagtcttccagctacagttagccatcagaggagtcccgtgtctcccaggaatggcttgccttaatgcctgctgtgaccagtcactggctgggaacagcccatgggaagcagggctttgcaccaatcctgctgaggatgtcagagcacaggagcacagccttgggacattacctgtgagtatcactcaatccttccttcctgagggttctgggctcttgaatatgaaaccctctcaggctgggttgctggatgattctgctcacacttacaacaggacaaggggaaccataaggtctccaagtggatctcttatttccacacacacatctcctgccctccttgtgtgatagcagccctgcctcctcctcttctcacctgcttgtatctggacacatactattcaaacatccctgggggcagccataatgtgtatttccatggactctcatttaaatgtctccttgccagggtgccccctttgggaaaccaggacctcctcccctacagagcccagatattggagatgagaagtgcaaaatcaccctgaaggtgaatataagggtttagatatggagccacacctgcttctacttcttggtttttggacccacgtattcttccttctgtaaacacagcactatagagacatctttgattcaatacatgcaccacatcctgaaagatggcacccattcctcagagggtttcatccaagctggcactaagttgtgtctgtagagacctgtccatgactctgtgtggctggcagcccctgggaggtgcaggtggtgataagaccagggggtgccatggtcatggaccacgcttcatcccctttcctctgaggtgtgtcccgcgggcagataatgtactgaaattctgagccagtggctcaggaatgccaatagtgatactggctgagggtctaagagtagagaggaaaaccacaccacatctaataggtgcctatccctgtgaggatgaacctccgccccccgggccgcctcccacttgagctgggtgatctgagccgccgtgtctgcggctgtcaaggagcacaggtcctcgttcaggacgatgtaatccttgccatcgtaagcaagctggtgatacccgcggagtaggcgcccgtccgaccccacgtcgcagacagacatcctctagatgggtgtgagaccctggccccgcccccgcggccagccccgcccaccgagccccgccctcgccaggaccaacctgcggggattttggctgaaaatgaaaccgggtaacggctcctgggcctctcccgggtcaagggtctccaggtcccgctgcctcggcgtggatctcggacccagagactcggggagacccgggcggtccgtgggggatgtggaggggtagtgacctgcgcccccggccggtgtcactcacaggcctcactctggttgtagtagccgctcagggtccgcaggttcactcggtaaaactgtgctttggccttggcggtccctgtctcctcttcccaatattccggcccctcctgctccatccacggcgcccgcggctccatcctgggactcgtggcgtcgctgtcgagccgcacgcactgcgtgtcgtccacgtcgcccacggagaggaagcggggatccgcgcggccgggccgggacatggtggtgtggaaatacctcaaggagtggaagcctgggagcaaggagggggctgagaccctcccgaccctcctcccggcaccgcaaccgggttcctgcgcccccgccgggcaggcccctagctactccccacagacgccgtttccctcccgaccccgcactcacctgcccaggtctgggtcaggaccagggcccccgagagcagcagaagcagggttcggggcgccatgacaccatcctcggcgactgggaagaatcggagtcccggtgggtgcgtgggaactttagaaccgggaccgcggctacattgattggcttctctagaaacccgacactcaatgggagtgagaactggggcagcccggtgagtacccaggaagaaggacccgacacaggttgggagagggagaagagaaaccctgcaaagatggggaatgcccagcgctgggcctccccaatccatacaccgcctttggggcctgagatcctgagagccacgcctgaggccctgggacttcgccctgaccccgctacttctgtgccaagcgctctgtctcaatgtttccctgagtcttggcccaggagctgtctgagaaaccagggagaaaccctcggaatgggccccgtccctctctcttcactttgcatcacggaatccccgtcccagaactggactccctgcctcctactccttacctgtccccgtggactcttctagaagaaaaatcaccccagggagcttgttgccagagagtgagcttgccctgggaatggaggtgtagagacagggttttttgttgttgttgtttgtttgttttttaaatctggaaaagttgtgcctgagtgcatgagatagaatagagaccagtttgctttttgtttattaactacagtgggtagcagaatcttggtaactcctaatgatcaggaatctaatcggccaaaaatgtgactttggtcccttgacatataaatgtgtctaaaagcattacaacaggaatcacaaagctcctaagtttcactttcccagacaatgtatctgtgactcccgcttgtagtattttaaatttaccttcattccatagccctgagtttctgtgtgagtccaggacatctcctaatacaaggtagccactgtgttactatatgttgtaaccaggagccagtacggactttattcatctcacagtggcaagcactcaatgcagtcacaatgcccctcaccagtgctcatgcactgcctgtttttaggaagtatccacttctaagtgttgtgtatattttatatgaacacttagtattttttaaacctgattaacataaaaaaattagtttttaggcagacccacataaggtattaaaggccaactgcaaagatcaccctgcaaggctctgtagattgatgtattaaaatatataaaacaatgtgtttaaacctgagttctgctgctttcgaattctttccctctgctccatttcctcacctcctgcatctccagcccttccctccattcctctcatgcctcaggccctcctctccccttagtccccaccaccttgtcactccttatttgtgacactagcactgtcccattacctgctacgtgactgttctctgcacagtggtcctgctcctgtgagtcagagtgtgtcatttctccacctaaaacattccactggctccaccttggtcttgtgaagcttctggaatgtcaggcacgtaagcatatgagggcacacctggttcattgtagggattaaattaatttttcttgactgaatgaatgaaatatgagtctattaaattgcatcacagaaaattataaaatgtaaaatactgaaaaagttaagaaatattttattttatgtaattagtgtgcatatcaattcatcaattcattcgtgcactaccacgactggcaaaacaacacccatttatctgcttatacttccttggtcagaaatctgggcaagatgtggatagaatccctgttctgggcttccaaaagctgtgttttcattttgaatcctccttcaggcttatacagaggtggcagaatgcagtttctggcagttgtaagactgaggtttctgttccttgctggctgtcaatacagagaataggcagggttgtgctcaattcctggtgcctaacagtgttctttcctacacagcctcttcattttcaaagcccacggtagaggaaacccctcatgctgaatccctctcacactgcaaatctctatgctcagaaagaacacagacctttcaaggactcaccttattaggacagtcaaagcaggataaacccagcctaaagtcaactaattgaggcccttagttatatctgctaaatcccttcacagcagcatctacactagagttgcttgaataactgggggaaagtgaatgaccgggaggtggctgttgggggccatcaaagaatcagcccagcaagggttggatcttccttttgtgtttaatttggacacagttggaaattgaagttcaagtaaagtgatcattgtgaatggtaataaaatgcatcctcttcagccatggacattctccttaccttttaaaactaagttacatgtgtaatgtcttataattaatttaggccaggtgtggtggctcacacctgtgattctagcaccgtggaaggcagaggaaggcagatttgttgactccagatgttgaagatcagcctgggcaacatggagaaacccccatctctacaaaaaaatttagaaaattagccaggcgtggtgcttcatgcctgtagtcccagttactcaggacgctgagataagagggtcccttgagcccaggaagtcgacactgcagtgcatggtgatcatgccactgcactccagcctgggcgacagagcgagaccctgtctcaataacaataatattaataataatgataaatttagagcaaatgcaaattaatgtgtaatactacatcctcttttgtgaaaatgtgttagttatttactattgcataacaaattatgtaaaacttagcagctcaaaatggcaaatattcatcatctcccgcaggttccaatggtcaggaatccaggagaggtttccctgagtgcttcttgctcagggcctctcacaaggttgcagtccagttgtcagcctaggcctgcatcatctgagtgcttcactgggactgaggattcacatgaaacatggatgggtcacatggctgttggaaaagccctagttccttgttttctgttcccagaaggccccagttctcagccacatggaccttccttcagggctgcttatggcacagcaggtggcttcccccagagctcatgattccagagacattgagagagaagggggaggctgcagtgagttttatgttctacacccagagtcacaaactcttatgtcagcattaccagttagaagttgtattagtccgttctcacattgctataaagaaatacctgagactgggtaatttataaaggaaagaggtttaattgactcatagttctgcattgctgagaaggctgccccatgaaacttacaatcatggcagaagtggaggcaaacacgtccttcttcacatggtggcaggagagagaattgcagatcgaagtggggaaaaatacctcataaaaccatcagatctcatgagaattccctcagcatcataagagcagcatgggggtaccatacccgtgatccaatcacctcccaggaggtccctcccccgatacatagggattacaatttgcatgacaattcaagatgagaatttggtgggaactcagagccagaccatatcagaaatgcatcattaagtcccagccacactcaagagaggaaattaagcagcatctctggaagggaacagtattaaaggatttgaatatatattaaaagcaaatttaaaactcttgtttcaggattttgaaaatcaaaatttttttatctaattatttttcgttaacccttttagcttgtcttttaatttaatttaattttaagttccaggttatgtgtgcaggatgcgcaggtttgttacataggtaaatgtgtgccatggtggtttgctgcacctatcaaaccatcacctatgtattaaccctggcatgcattagctattttttcctaatactcctcccaccactgccctcccccagcaggcaccagtgtgtgatgttcctctccttgtgtccatgtgttctcattgctcatctcccaattataagtgagaacatgtggtgtttggctttctgttcctgtgttagtttgctgaggatggcttccagcttcatccatatccctgcaaaagactgaatctcattcctttttgtggctgcataatattccatggtgtatatgtaccatattttcttaatgcagtacatcattgatgggcatttgggctgattccatgtctttgctattgtggatagtgctgcaataagcatacacatgcatgtatctttataatagagtgatttattttcctttggatgtataccctgtaatgggattgctgggtcaaatggtatttctggttctaaatctttgaggaatcaccaaactgtcttccacaatggttcaaccaatttacatttccagcaacagtgtaaaagccttcctatttctccacaacctcgccagcatctggtgtttatgtagttttaaataattgccattctgactggcattagatggtatctcatttgtggttttgatttgcatttctgtaatcagtgatgttgagctttttttcatgtttttttggccacatgtacatcttattttgtgaaatgtctcttcatgtcctttgttcactttttaatgaagtttttttcatgtaaatttgcttaagttctttatagattctgaatattagacctttgtaagatagatagattgcaaaaattttctcccattctgtagggtgtctgttcactctgatagtttctttttctgtgcagatgctcttttgtttaattagatcccatatgccaatttttgcttttgtggcagatgctcttggcgatttcatcataaaatctttgcccatgcctgtgtcctgaatggtattgcctagattttctttcagggtttttataattttgtgttttacatttaagtctttaatctatcttgagttaatttttgtgtaaggtgtaaggaaggggtctagtttcaattttctgcatatggctagccagttctcccatcaccatttattaaatagggaatcctttccccgttgcttgtttttgtcaggtttgttgaagatcaaatggttgtagatgtgcggactttttttgtgaattctctattctgttccattggtctatgtgcctgtttttgtaccagtatcatgctgttttgtttactgtagcctcacagtatacttttaagtggggtagtgtgctgcctccagctttgttctttttgcttagtattctctttgctatatgagctcttattggatccatatgaattttaaaatagtttttttttctaattccacgataagcttatcttttaaaattaatgattaactgtttcagacatcacagagccttgggtgcttaggagaaaacagtttgaaacagagaaaggatatgcaacagtaactctgaatttttcttgtgaatacctttaataacaatgttgttttcaattagttaacacagttgagaacatagagtaactagatcaaatagttccaagacttcagtctgataaaaataatgtcttgaaaataagactttgttttgtctaagatatctcaaatttagtggaagcacgtcccaagcaccaattttcttattgaaatatcatcttcactaaacatttgcctacacttaaaaaaaaaaacaaaaactccgctatatggagtagccattcttttgtttctttacttctctaataacttgctttcacttaggaaaacattgcctaatcaaattgcttttcatttacaaaagtgtgaatctcatacttcagtcaacacatctagcttagcatgatgccaataactttggtttgatgcagtagcctgaaatggttagctcaaattgagaaacaagtttttttcaaaagctagctatttggtgggcattacataataaacttaacatcttttgctctggtattgaatgagatgtgatagaagtcatttgcacaccactatgattctaaataacacggctattatgtgcttctgaagctttttttctttttatcagtcctattctgttttccattcatatttgatattccatcactggttattccttcctattcttttcttgtttgatttattttgatcaattatttgcatttccaattccgtaaaagtttaattcagttgtatgtgtggtagaatgtaacatcaaatcctttgcaagatggaattaccttgcacagcagattgaacattgtataactgaaaatctagagagatgccagtcagccaagggttaaatgacctatttttagccaagtccattttcatggcatcctggtcctctctgtcacatgactccttacaattctctgtggtttgcttccaatgtaagtagttcttattaaggatccttgcaattaactttggtattcttttctcttacatttttttaaaattatactttaagttctatggtacatgtgcataacgtgcaggtttgtcacatatgtatgcatgtgccctgttggtttgctgccctctttaactagtcatttacattaggtatttctcctaatgctatccttcccccatcccgccacctgacgacaggccccagtgtgtgatgttccccaccctgtgtccaagtgttctcattgttcaattcacctatgagtgagaacatgcgctgtttgattttctgtcttcgcgatagtttgctcagaatgatggtttcctgcttcatccatgtcactacaaaggacatgaactcatcctttttatggctgcatagtattccatggtgtatatgtgccacattttcttaatctagtctatcattgatggacatttgggttggttccaattctttgctattgtgaatagtgccacaataaacatacatgtgcatgtgtctttatagtagcgtgatttataatccgttgggcatatacccagtaatgggatggctgggtcaaatggtatttctagttctagatccttcaggaattgccacactgtcttccacaatggttgaactagtttacagtcccaccaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgcctgttcatatcctttgcccactttttatggggttgtttgatgggtagactgcaaaaattttctcccattctgtaggttgcctgttcactctgatggtagtttcttttgctgtgcagaagctttttagtttaattagatcccatttgtctaatttggcttttgttgccattgcttttggtgttttagtcacgaaatccttgcccatgctgatttcctaagtggtattgcctaggttttcttttgggttttatggttttaggtctaacattgaagtctttaatccatctggaattaatttctgtgtaagttgtaaggaagggatccagtttcagctttctacatgtggctagccagttttcccagcaccatttattaagtttcccagcacctttccctattgcttgtttctgtcaggtttgtcaaagatcagatgattgtagatgtgtggtgttacttctgaggcctctgttctgttccattggtctgtatctctgttttggtaccagtaccatactgttttggttactgcagccttgtagtatagtttgaagtcaggtagcgtcatgcctccagctttgttcttttggcttaggattctcttggcaatgtggtctcttttttggttccatatgaactttaaagtagttttttccaattctgtgaagaaagtcattggtagcttgatggggatggcattgaatctataaattaccttgggcagtgtggccattttcatgatatggattcttcctatccatgaacgtggaatgttcttccatttgtttatatcctcttttatttcattgagcaggtttgtagttctccttgaagaggtccttcacatcccttgtaagttggattcctaggtattttattctctttgtagcaattttgaatgggagttcactcatgatttggctgtctgtctgttattggtgtgtaagaatgcttgtgatttttgcacattgattttgtatcctgagactttgctgaagttgcttatcagcttaaggagattttgggctgagatgatggggttttctagacatacagtcgtgtcatctgcaaacagggacaattttacttcctcttttcctaattgaataccctttatttccttctcctgcctaattgccctggccagaacttccaacactatgttgaataggagtgatgagagagggcatccctgtcttgtgccagttttcaaagggaatgcttccagtttttgcccattcagtatgatattggctgtgggtttgtcatagatagctcttattattttgagatacgtcccatcaatacttaatttattgagagtttttagcatgaaggttgttgaattttgtcaaaggccttttttgcatctattgagataatcatgtggtttttgtcgttggttctctttaaatgctggattatgtttattgattttcgtatgttgaaccagccttgcatcccagggatgaagcccacttgatcatggtggataagctttttgatgtgctgctggattcggtttgccagtattttattgaggatttttgcatctatgttcatcagggatattggtcgaaaattctctttttttgttgtgtctctgcccggctttgctatcaggatgatgctggcctcataaaatgagttagggaggattctctctttttctattgattagaatagtttcagaaggaatggtaccagctcctccttgtacctctggtagaattcggctgtgaatccatctggtcctggactatttttggttggtaagctattaattattgcctcaatttcagagcctgttattggtatattcagagattcaacttcttcctggtttagtcttgggagggtgtatgcgtcgaggaatttatccatttcttctagattttctagtttatttgcatagaggtgtttatagtattctctgatggtagtttgtatttctgtgggattggtggtgatatcccctttatcatttttattgcatctatttgattcttctctctttattagtcttgctagcggtctatcaattttgttggtcttttcaaaaaatcagctcctggattcattgattttttgaagggttttttgtgtctctatctccttcagttctgccctgatcttggttatttcttgccttctgctagcttttgaatgtgattgctcttgcttctctagttcttttaattgtgatgttagggtgtcgattttagatctttcctactttctgttgtgggcatttagtgctataaatttccctttacacactgctttgaatgcatcccagagattctggtatgttgtgtctttgttctcgttggtttcaaagaacctctttatttctgccttcctttcattatgtacccagtagtcattcaggagcaggttgttcagtttccatgtggttgagcagttttgagtgagtttcttaatcctgagttctagtttgattgcactgtggtctgagagacagtttgttataatttctgttcttttacatttgctgaggagtgctttacttccaactatgtggtcagttttggaataagtgcggtgtggtgctgagaagaatgtatattctgttgatttggggtggagagttctgtagatgtctattaggtctgcttggtgcagagctgagttcaattcctggatatctttgttaactttctgtctcattgatctgtccgatgttgacagtggggtgttaaagtttcccattactattgtgtgggagtctaagtctctttatatgtctctacggacttgctttatgaatctgggtgctcctgtattgggtgcatatatatttaggatagttagctcttctcattgaattgatccctttaccattatgtattggccttctttgtctcttttgatctttgttggtttaaagtctgttttatcagagagtaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgcagtttcttcctagcctcaatggtctttactatttggcatgtttttgcagtggctggtaccagttgttcctttccatgtttagtgcttccttcaggatctcttgtaaggcaggcctggtggtgacaaaatctctcaggatttgcttgtctgtcaaggattttatttctccttcacttacaaagcttagtttggctggatttgaaattctgggctgaaaattcttttctttaagaaagttgaatattggcccctactctcttctgccttgtagagtttctgccgagagatcagctgttagtctgatgggtttccctttgtgggtagcccgacctttctctctgtctttccttaacattttttccttaatttcaactttggtgaatctgacaattatgtgtcttggagttgctcttcttgaggagtatctttgttgtgttctctctatttcctgaatttgaatgttggcctgccttgctagattggggaagttctcctggataatatcctgcagagtgttttccaacttggttccattctctccgtcacttgcaggtacaccaatcagatgcagatttggtcttttcacatagtcccatatttcttggaggctttgttcatttctttttattcttttttctctaaacttctcttctcacttcatttcattcatttgatcttccatcactgataacctttcttccagttgatcgaatcagctactgaagcttgtgcattcatcacttagttctcgtgccgtagttttcagctccatcaggtcctttaaggacttctctgcattggttattctagttagccattcatctcatcttttttcaaggtttttaacttctttgtcatgggttcgaacttcctcctttagctcggagaagtttgatcgtctgaagccttcttctctcaactcatcagagtcattctccttccagctttgttccattgctagtgagtagctgcattcctttggaggaggagaggcactctgatttttagaattttcagtttttctgctctgttttttccccgtctttgtggatttatctacctttggtctttgatgatggtgacgtacagatggggttttggtgtggatgtcctttctgtttgttagttttccttctgacagtcaggaccctcagctgcaggtctgttggagtttgctggaggtccactacagaccctgtttgcctgggtatcagcagcggaggctgcagaacaatgcatattggtgaacagcaaatgttgctgcctgatctttcctctggagattttgtctcagaggagtactcggccgtgtgacgtgtcagtctgcccctactggggggtgcctcccagtcaggctacttgggagtcagggacccacttgaggaggcagtctgtctgttctcagatctcaagctgcatgcgggagaaccactactgtcttcaaagctgtcagacagggacatttaagtctgcagaggtttctgctgccttttgtttggctatgccctgcccccagaggtggagtctacagaggcaggcaggcctccttgagctgtgtgggctccacccagctcgagcttcctggccgctttgtttacctactcaagcctcagcaatggcgggcacccctcccccagccttgctgccgccttgcagtttgatctcagactgctgtgctggcaatgagcgaggctctgtgggtgtaggaccctgcgagccaggcatgggatataatctctcggtgtgccgtttgctaagaccataggaaaagtgcagtattagggtgggagtgacctaattttccaggtgccatctgtcacccctttccttggctaggaaagggaattccctgaccccttgcgcttcctgggtgaggcgtggcctcgccctgctttggctcacacttggtgcactgcacccactgtcctgcacccactgtctgacagtccccagtgagatgaacctggtacctcagttggaaatgcagaaatcattcgtcttctgcattgctcaccctgggagctgtagactggagctgttcctattccccaaattaatttttgttgactgaataaatgaaatatgagtgtattaaaatttaatttcatcacagaaaattataaaataaacaatactggaaaagattgagaaagtttttattttatgtaactagtgtgcatatcaattcataaattcattccatttgtctgttgagactgtacgaattttatgactgcataacaaattatcacaaatattggctttaaacaatacccatttatttaattaattcatttatttttagagaaatggtctctttctctcatccattttgaagtgcagtcacacagtcatggctcactgcagccttgaaatcctgggctcaaaggatcctcctggctcagtcttcagagtaactagaactacaggcaaatgccaccacgcccagctaattaaaaaaaaattgtagagatgagggtctcattgcattacccaggctggtctcaaattcctgagtgtaagtgatcctcctgtgtaagcccctcaaatgttaggattgcaggtgtgtgctaccacacctgcccaaacaacatccactgatctgtttacagttctttaggcagaaatccaggcatgatgtagacggggtctctattcagggcttcccaaagctgtgttttcattttgaatcctccttcaagcatatatagaggcggcagaattcagtttctgacagtcgttaagactgagtttcctgttccctgctagctgtcaaggtagagaggagggagggctgtgctcaatgcctggagccaaacagcattcttttctagtcagccccttcaatttcaaagcccacagtggaggaaacccctcacactgaatccctctcacactgtgaatctctatgctcaggaagaacccagtcctttcatgggctcacctgattaggagtgtccaagcaggctaaacccagcctcaagtcaactgattgaggaccttgattatatctgctaaatcccttcacagcagcacctacagtagagttggttgaataattgggggaaggtggatgaccaggaggtggttgttgggactattatagaatcagcctagcaagggttggattttccttttgtgtttaattgtgacacagttggaaattgaagttcaagtaaagcgatcattgtgaatgataataaaatacatcctcttcagccatggagattcaccttacctcttaaaatcaagtgacaggtttaatagcttataattaattcatgccaggtgtggtggctggcacctacaatcctagcactgtggcgggcagaggaaggcagatccattgactccaagagtttgagatcagcctgggcaacatggtgaaacctccatctctacaaaaacattagagtattatccaggcatggtggttcatgcctgtagtcccagccagctactcaggaggctgaggtcagaggatatttgagcacaggaagtcaacacagcagtgaatggtgaacatgccactgcactctagcctctgtgacagagcaagatgctgtctcaaaaatagtaataatcatgatcataaatttagagcaaatgaaaattgaagtgcaataaatcatcctctcttatgaaaatgtattagttatttactattgcataacaaattacataaaacttagcagcgcaaaacaacaaacatcatctaccgcagtttccaatggtcaggaatccaggagcaaggtttccctgagtgcttctggctcagagcctctcacaaggttacagtccagtccagggctgcatcatctgagagcttcactagggcttgggatttacaagaaacatggctcactcacatggttccttgttgtccggtcccaggaggcctcagtttttagccacatggaccttcctgcagggctgcttatggcacagcagttggcttcccccagagctcatgatcccagagacagagagagagaagctgcagtgagttttatgttctacacccagagtcaaaaactgttatatcagcactactctatcagttagaagttgtatttgtctgttctcacactgctataaagaaatacctgagactgggtaatttataaaggaaagaggtttaattgactcacagttctgcatgactgaagaggtggcctcaggaaatttacaatcatggcagaaggggaaggaagcatgtcattcttcacatggtggtgggagagagaaatgcaaggttgtcgggggcgggggtggcagggaagactcttgcaaaaccatcagatctcatagaactcactcactatcatgagaacagcatgagggaaccatccccatgatctaatcacttcccaccatgtctttcccctagcacgtggggattacaattcaagatgagtttgggtggggacacagggtgaggccatatcagaagtgcatcattaagtccaagccgaactcacagggaaggaattaagctgcaccattggaagggaggagtatcaagggatttgcatacatgttgaaagcaaaattaaaattattatttcaggattttgtaaatcaaatgcttctttcatgtgattatttttctttaatgctttaagcttctttttaatttttattttaagtttcagggtacatatgcaggatgtgcagatttgttacataggtaaacgtgtgccatggtgttttgctacacttatcaacccagcacctaggtattaagcctagcatgaatgagctatttttcctaatgcgcaccccacctctgccccccccccaaaaggacacagtgttcccctcccagtgcccatggattctcattgctcagctcccaattatcagtgagaacatgcagtgtttgtttttctgtttctgcattagtttgttgaggataatggcttccagctttttccatgtccctgcaaaacatgatctccttcctttttaaggctgcatagtattccatggtgtacatgtcatatgttttctttatccagtctattgttgatgcgcatttaggttgattccatgtctttgctattgtgagtggtgctgcaatgaacatacacatggatgtaactttataatagaatgatttatatttctttgggtatatacccagtaatgggattgctgggtcaaatggtatttctagttctagatctttgaggaatcgtcatattgtcttccacaatggttgaactaatttacattcccaccaacagttaaagcattcctatttccctgcaaccttgccagtatctgttgtttcttgactttttaataatcaccattctgactggcatgagatggtatctcattgtggttttgatttgcatttctctaatgaccagtgatgatgagctttttttcatatgtttgttggccacatgtatgtcttcttttgagaagtgtctgttcatgtcatttgcccactttttaatggggttgtttgttattttcttgtaaatttgcttaatttccttgtagattgtggatattagatctttgtcagatggatagattacaaaaattttctttcattctgtaggttgtctgttcactctgatcacagtgtcttttcctgtgcagaagctctttagtttaattagatcccatttgtcagtttttgcttttgtggcagatgcttttggcgatttcatcataaaatctttgcccatgcccaggcaaatggtattgcctagattttcttcttgggtttttatagttttgggttttacatttaggtctttaatccatctagagttaatttttgtgtaagatgtaaggaaggggtccagtttcagttttctgcaaatggctagcccgttttcccaacatcatttattaaatatggaatcatttccctgttgcttgttttcatcaggtttgttgaagatcagatggttttagatatgcggttttatttctgagttctctactctcttccattagtctattaccatgctgttttggttactgtagcctgtagtatagtttgaaatcaggtagtctgaggccgcctgctttgttctttttgtgtaggattgtccgggctatatgagctcttttttggttccatatgaattttaaaatagtttcttctaattctgtgataagcttctctttttaaattaatgattaaaagtttgagacatcacagagccttgggtgttgtggcgaaaactgtttgagacagagaaagaggatacaatagtatgtctgagtttttcttgcaaatacctttaataacaatattctcttcaatgagtcaacagttgagaacccagagtaactagagcaaatattccaaagacttctgtgccgtaaaaataatgacttgaaaataagtctttgtttcaactaaggtgtctcacatttagttgaagtatgccccaagtgccaattttcttattgaaatatcatcttcaaaaaacatttgcctacacttaaaaaaaagggctgttgtgtctattgagtagccattcttttgtttccttacttctctcataaacttgatttcactttaaaaaatttgcctaattggttttaatttacaaaaatgtgaatctcatacctcagttaacacatctagcttagcaagatgtcaatagctttggttggatgcagtagcccaaaatggttagctccaactgaggcataagatttttcaaaaactggctatttggtgagcattctataataaacttaacatcttttgttctggtattgaatcagatacgatagaagtgatttggacaccactatgattctaaatggcactgcaattttgtgctttcaagtttttttgagcaatcctgttgtgttttccattcatatttgctattccatcactggttgttcctttatactcttttattgtttcatctattttgatcaatgatgtgcatttccaattctgtaaaagtttaattcagttgtatgtgtggaatatgtaacaaatcaaatcctttgcaaaatggaattaccttgcacatcagattgaatcttgtatacctgaaaatctagagagatgcctgtgagccaaggatcatatggccctttagccaagggtattgtcatggcatcctgtaaggagcctctctgtcatgtggctccttacaattctctgtggctttcttccaatgtaagtagttcttgttaaggatccttgcaatgaactttgatatttttttctttcattttttaagaaacaggtatattttagtttgaaaaatactgtttaaggagttataatctagtagttacctgggttcccagcactggcataagacacagaacccgcaaagccaccctgggctgctgcccaatcacatcccccagaatgagaccccatcctgagtcttgtttttattattactttgtatttctttaaatatttgtacaataagtatatataatctcaaaccaaatattagtttcactggtttttaagcttcctgtacagaaattcctactacatttcttttctcatgatgcacattatgtataggagttatctgttgtgtgggaggctgtcattcactcatttttactgctgaaggtttacattttatggttataccacaatttcactactttgctattgatgtataggaggctgattccagtttttgccataaacattagtgtgcatgtctcctgggcacataggcgagaaagccgccagagtgtatgattaggagtgggatggttggatgatatgttgtatggcctttaaccatactaaataatgataatatgatttccaaagtaattgtgccaacttaagcttttacaataaatgtgtaatatgtgatgttgatgtgttctgaaaacactgagttgaaggaattaagagttaatagcaactgccttggctgcagaattatagcagattttttttttgacggagtcttgctctgtcgcccaggctggagtgcagtggcacaatctcggttcactgcaagctccacctcctgggttcacgccattctcccgcctcagcctcttgagtagctggggctacaggtgcccgccaccacaccggctaattttttttttgtatttttagtaaagacagggtttcaccgtgttagccaggatggtctctatcccctgacctcgtgatccgcccgtctaggcctcccaaagtgctgggattacaggcatgagtcaccatgcccagcctatagcaggcattcttattcagactctgttaataacttcctgttgttaacttgtatcctatataccatggctttatacttttaacatatagattcagaaaatgtttccttatagtacaaacacatagggttattttatatgtcagaatatgtcataataaaaaagaaaaaaatggaggaaaggagagaaagaaggagagaggagtgaaggaagcaaagaaggaaggggaagagaaggagggagggagggcaaatggaaatagaaaagaaagagagggagggagagatagaagtgagaagaaagggaaggaataaaggagaaaagaaacgaaaataaagaaaaaaacaggcgtagagaaactaggaacccaatatatggctaatattatcaaaatgggaggaaataaaacggatgtatttaacctctatagaataacagaaatgtaagagggcttcattagttatccattgctgtataacaaactacccccaaatttagtgacttaaagcaacaaacatcgactatctcaaaagcataatacaaatactagcaaaatggagccaatgcaggtagaagttgaacaaacaaaaggattttacaaattggagtaagtaagaggtcactggtgtgcagatgaaaatgattttgcattccaagtgccatcatgggattaaagttacaggattttattaggggacacacctgtcagagatatagcaacggaggcaggttaccctgggaaaggcaacagaccaagatgcaaatgtgacccccagtgatggacagaaggacagaaggtttactggatgtgtcctagaccacaggcaatctcaggagagttgagcaaagccatggaggagtctttgagccactgctgtccgtcagaggagtccctggtctcccaggaatgtcctgcctcagtgtcactggtgtgacccatcactggctgggaacagcccatgggaagcagggtctctgcaccaatgacactgaggatgtcagagcacaggagtggggccttgggtgattacccaggagtgtggctcaaacctcctgtcctgagaggtctgggcccttggaaatcaaatcctctcaggctggattgctggatgattctgctcacatttacaaagggacaaggcaaaccagaaggcccccaagtagatctctggttctcacacacacacttctgccctcattgtgtgaaagtagccatgcctcctcctggagatcaggatctattacctgcacctggagaggaagagactccttttctcaccagctggtctctgggcacatactgtccaaacttctctggtgacaaccataatgtgtagttcaatgggctgtcatgtgtctctttttaaggacctcctgccctgaacagcccaaagttgggagataaaacgtgcaaaataccccagtgggtgaatctaagagactggacatggagacaaacctgcttccaactttcggtttctagacccacatattcttcctattgagaacacagcaccgtagagatgtctctgattcaaacaatgcaccatgtcctgaaaaacggcccccacccctcagagtgcttcctccaggatgacactgagttttgcctgtagaagacatttccagcattccttgtggctggcagcccctgggtggtgcagatggtgatcagatcagtgaaacccatagccacggaaacactggaactttccctgccaagtgggtccttcaggcagatactgggttgggagcaccacctagcctgtggatcaggaatgtcaacagcacccagagagtggtgctggctgagtgtccgagagcaggacaggaaaactcacccatggaatatgagcctacccctgtgaagatgaacctcaggcccttctaggatggaagtagctaaatgtagtcaacttgttacatagtggctagttagtcacctaaagaaatagtgccccactagggcacatggtgggcctcaaatgctgatgagttggacattcagaggtggcagcagctggatctgtcttgataatggggagtcagtacttctggccccatatgtagcctcatgcctgccactgtgcttgctccattcatgtgcccatcctaccaggcctgcattgacccatagtgaaggctggctaacttccatttgtctgtttggttgttcagtgctgcttcagacttgggtgttttctgggggtgtcaacatgggattcaagcacaacccaggtggaccattttcacctcatgatgaatgctgttgggcctgtccaatctatgactttctgggtcacacagaagccaattcacacaggtacttggaatcacatcgttgcttggtgtcctgtggttaagcattctatcgaatcaggaccaggaacactaaaagttgcttctaatggggagccatgtctctgctgtggatgacatgatcttactccagatcccaggccctccaccatgactctcccactgctgcttggttcagctccatcctgcatctttccccacccctgccccttccagtaccaagaggtctgagggatggtggctgcaccgcagcctgtatctgctgcagggtgctttcctgtgtaggcctcacttgaagctggcctcctcctatgtcacctagagtgtgggccaaagcaacatttctacatgtggaatgtgctgtcgtcagaactccaagaggctcaccggagagtgtgctttctttttttgcagtaaggatgcaaaatgcaacactttgtaatttacctaggaggggacacccctggcattcccctaaacactggactcataaaacttcactacagtgacctttcctgaagctctgtaaggtttatcttcaccttctgaagtgcaaatgttttgccaacgatgccagtgcactttctacctgctgctcattcgccccagtcaacatgaagttgtaaatgaaatgagctgatttaatatcctttaggatatccagtatgtctagtatagtcataagactatactatagaggacaggggagttacaaaagtcctgaggcaaactataattcaatgtgttgtggatcccacatgaatgtgaatcactccatatcccctttgtaattggaatggaaagaaatgcactcaccaaatccacagctgcacactgtgtgcccaaggctttgttaatctgctctaccagtgatatccagacagcacaaaagctgcacttataactcctacttggccatatctggagtaatctcattcattctttaggcctcactaggcttcctcagggacagattgctggattacacggagacaataggcagcctcaacaccaccccgcctccttcagctttgtaatggtggtgtgacccccacaatacttgcagtgtccttcacaagacccacgctgggacacactatgatttttgatttggccaggatgggggcagtttcagaggtttccctttggcctttggcatcaagagatcccttataccacagactggggacccagtgtgggggtgactccacttaccagagcatcagtgtcaattatgcactcagggaattggaagataatcagggttgggtctatgcatccagtggtcccattgcgggccataatgtgtccaggtttactccctggcctccgtaagccccactgtgatggagaagatgattgtgctgtgggcatctgggcatcaatatcagcttacatgcaatgaaaatgatcccccctagttctgcctatttcccttccccaatgtacagtctcctgagtaaatggctataggttcccttgctgaaagactgagggaattgtcccagccatatatctccatggtgtcccagggtcctttctctagggatatggactcctcctctgtcactgagatctgagtctgaatcttgattgaggtctaggcattgagaaggggatcatggctttgtatttggtcgaacaccctcagtctcctgctcctcaattcttgctttcttatcatatatatcaagcagtgcccttgttggctgcctcttgtaaccctggtgtcctctctactaactttccccacactccctgcagcttgagtccccttggctgctcctctgaggttgccatggtaaccatgccctccggcttttgcaggtcactgccaccacttgttctcagtctcttcaggcccacattctccccagagatatgaataagcacaactctgggacctttactatcatcccccccagcctgcagaggataacaccccgacacttcttagtgatgcaggtccctctccacagcatgttcctgaggctctggtggaaggtgtgccctctgggtcctcttgtggagcatggtcctggtgggccttcatcacgcccacttccctcagccttgttattgcatcctctacatgttccaggataactaggtcatatctaccttgttgagagttgggcatcattttttccagtctatatggactcaccccagtagtgggtttaccccatgtcctgggttctttgataaacccatgtcctgagaaagtgcctccaagccaaaggatttttattcatccagactgaaattctagtttattgatcaaatgccctcaaattccaatcccagaagtgcaccccaggcccctatggggacatgctggctagttcctgcaaagctcctgagtgggattcctgctgcatcgtaggagtgaggcttctgtagcatctttcagcataggaagtgggaacgattactagagaagggtgagcctcctctgcatgcccaggggttcctggaggagggcacccatcagataactctgttctagtttgcagaatctgaggttcccccaccagggccctgactttcctataaaaggcctgtgttggctgagtatcaaacgtctctggagcactgtgcccaccataatgatgttcagctaccattccatgctatctgctcttttgatccaggagataaaggcctctccatgagacactgcagagactctcacacatagccagtgacagctgttaacaacctgcagattctcattatccttttatagagcatcaacacagctgggaagtaaccagccaactccactgtctttgtgggtttacccccaactccatcattattgtgcagggcattctatcaccacatctgccatagcttcccctaaccagagcatcttctcaggttagcactggtgagacccacggcagctcagatgcaacttctctatggactttctttgtcccccgctaacctagatggcatcctcttggcctgacaggcagtgggaaagcttatttcaaatttccagttttggtcattttcatggatcacccttgataccacttgtgatagctgcggtcctgaacttagaccccaatacagtattaaatgtgtaaggatttattaggggaaatagttgtgagagaaaatcaggatagagacagaaatgctggaaaagccatcagatcacaatgcaactctgagtcccagtgaaggagagagggcaggaaggtcagctggaagcatcctagaccctgtgtaggctaagggaagctcagtagggatggcagggagtcctggagcctcagccagccttcagagtaggaatattcttgccttagttttcctgctttggtcaatcattggttggaaaaagctggggcaggtgtggtctcagatcaaatgtgacaatagatttcaggctgcgacagctgggacatcatcaattattcttcctctacctgagggcctgggatgtgcatcctcatgagtgccacaatgatccactggaataaaaggaaaagggatgacaatagagggaaaaaaaaggtattaattgatgaactaacactttaagtagatgagaagggatgatgttcagggcaccagcagaggaactggctctggctgggagcaggatggttaacacacagcaatcccccatgtagtaaaatgcctgacatgtggtgcagctgcaaatgcatgagcagacggtggtggaatctgtgaagttgtcttctaaatgtgttcagttttctcagtgaagtaggaagcaagatcatcagcggaagtaagaatggggaaggaagattggatgtgtgaggacagagagaaggtatgtaagagtcacccaggccaggaggaggctgagagtgagccatgcagggagagggtgattgctggctatggtgggggctccccatgaggtttgggtcgtgaatgtagagagaacagtcagcatgctgtgtgctgctctccagcctcctgcagcttatgggggcaggtgcagtgtaggctgaggtggaatccactagctgtgtagttttgccaggcaagtgtgacaacgaaagggagaggcaagggagggatggaaattatttactacagaatccaaaatggatgaggagggaggagaggacaacaaacactaagggagaaggaatagatagcagcatcactggattgggaatttcaagggggtggaaaaattattggaatagatgtactacagaatggactccatgcctggaaagcaggcacacatgcaatgagtggttcactgatgttacattatagcatatgatcaaattatagcatcagtgtcttcagagcctgtggctaccctgcaaggggatgagtggaaagatggtcagagagtgggaagtgtgagattgagagtgtggaagggctggggttctttgccatgatgaggcctaggggaggacaaggtcctgagattccggcagagagaggagatggtaatgaagaaaaggagttccaggatctgagaggccagggagtgagggcatcttctctgctgtataggtgtctattgctgccataaaaattaccacaaaccaagcagctttaaacagcacctaattatcatgtcacagttgtgtgggttgcaagtccacccagtctcacggggctaagatcaaggtatgggcaggtctgtgctccttcctggagaatctggggaagagtccacatccaagcttattcaggttcttgtctgaattcacttcctgcagatagaactgagcttcccacttcctttttgggagcacccttagatcctagagacttctctctggtgcctaaagcacatccaatcctcctgcttggaaccactgatctcccctttgctgtgtctcctctgccttccttctctgcagcatgtgactccatctagagcagattctctccttttaatggctcatgtgatttgatcgggcccacacagagagtccaggatgatctccctactttaaggtcctttatcttcattacatgagtaatgtcccttttgccatgcaatgcaacctgttcaccgactccaaggactaagactggatctctttggggactagtactcagcccagcacatctgcatatgttgaagtcagaaagaatcaaggagacagcactgctggagagggtgacagtgatctaggagctacaagagttaggattgacaggaatggcttggggcccacagggaatggctacaatgaggggagcggcgccttagtctgatgacagcttaggggttttagggaggagggaggcagaaaggtctgagaaccacagtgaagagcaaggaccccacctcacctctgaacccaggggtataagttgctgggaaactcccccatgtaggggaacttcagagcgggtcacatcctcaggaagacctggttcctgctagagcttcgaggtgagggagcatcctgagagagaatgaggaggttttgctgatcatggactgaggattccagattccagggagtacagagggaagatttctggagttaggtaggggacatggtggggggacagaatagagcgtgcggagccttgtggggatgcaagtgctgggtatatgggggacccagtgtgactgacacaaacagggaaagggcatgaggagctcagtcctggtggactcgaggcagacgatggtgctgaggctgtgggagatgagggaggaggagcaggcgtggctgtcacctgggctctctccatggaggtgaagacagtgaggtggttgggtcttagtgctgtgtggaccttctgatgactggatggagtgtctgagggaggaggggtcttagaggattcactcgtgaccctgagggagggtatgttctcacttcaggtctcaggtgtgccctgacacctttctttgtggcttagggctccctactgtaaattattggggattagtaccttttggaatttgtaacttaaagcagaaactcagatggtcgaaatgtcattttcatgaaggtttgttattagcgtatcatttagattgtcttgcaaaagtctcattttttgttgtttttctaaagggctgtcgatcttgttttaaatttacaaatattgataatttatctccactcttaattggttgggggttgtttaattttgtactgcatagttttacatatctataacaacagtggtttgggcctcttatgttctaataattaagactttaagctgtgtacacattgcaattcaagtatgagtcatgcataaccctggcactaagagacaagagggaaagtccttctctcctaaaattttgcaaaggttctgggttctttttccactgagtgggaacaagtcagctagtgaggaacatgaggtctttggcctcatcgaaaggtgattcatctcccaactgtgagaagcactgaccactaggaagacctccctgcctggtccctggacccctacaccatggtagaggctatcttccctcccactgcagagtgatatcccagatagcaagctggttagctgctgccagctcttgggtagttttgtcttctaaggcatgggtttttatctgaaaatcttccccttcccagatgacccaaactggggccacccactcttttctgagccacctctgcccagagacctgtggctatgccctccagtcacaacagaacatcctttcagaacaccttgcaggaagctgagatctctacagactcacatgaatggtgtgtgcacagagctttggttctagttcaggaggtgtggagtgaggctcgctaatccaacagagcttgaggctagtactagtgtcatatgccaggaggcaaggttacagggaatacaaagtgtccagacctaccagagaaggcaaacccctgtaacaggcagggctagacagggacaagaaacaaggtcattctgggccagcaagaagagggaaagggaaattacagacatatctcagagagattgcagatttggtttcagatcatgcaaacaaaacaagtcacacaatttttttgtttttgtagtgtacataaaagttatatttatactttagcctattaagtatacaatagcattatgtataaaatagatatgtacataccttaattaaaaattacactactgctaaaaaatgctaacagtcatctgaggcttcagctaatactaatgtttttgctggagtagggtcttgcctcaatgttgatgactgctgactgatcacaaggtggctgctgaaggctgctgtggcaacttcttaagacaacaaagtttgtggcatggattgtaaagtgggaattagtacataagtaaggtcaatatgagttttcaagtcaagtggacctgaatatgaacccttcaggcctttccaccagctagctatagaaccctgggcacatctggcccacaattggccctgacagacactttcacagtgaatgagtgctgaatgaaaccatatgagtcagtttcctcatctgcaaaccagtgatgtaattcctgccttgccaattcagaagaatacatgagaagaaacatagtgccaagaaaaacagacacaagacctgtggaaggctgggcaccagtgctctaaagcaagatctgcctaaactggcaggaacatttttcacagcagacaggagttggtctggattctgtctggggccaggctgagagggaggtgggggcagcagaacgggacaggggcaggggcctatgcagggccaggcactgaagcaaagcccaggcctggaagggcgggctcctgatgtctgctaggaaactcagacagctccctgcctcacctgccatggtgtttcctcttccaggatctctcggagctgttgcctacacttttcctgccttggaaagtggagatgataacgaaaagctgttgccaaattaaaggaggctattgcctcctctcccctcctggtccctagcactccaggactcacaaagatgctgctctgaaaaccccaaggcaagcgtggaagagtagaacagctccaggggcagtgggaagatgagggcacccccgcatgttgacggacaccaagggtgggggtggaggagatgaaggggatcagcacaggagtctgggggaaatcctctaaatcccaccctgcaccaacctcacccctgcagctccttgggtagttacagctctcagctctcagctccttcccaaccacaccccagcccagacctcagggctcctccctctccccaccccctccagagcagcacagtccacagagcccttgaaaaggaattccccctcatctaacagttaattatttcttagtggggagggacagccggtcctctctttccagtgaccccatatctttgttcaaggcatccagttatactccctgagccagggatctctaggccagctgggacctaacagcttctccagttgctcaggggtcagcacttatgcaacctggcatctgtgcctggcacttccttcagatgtctggctgtcctcggagggctggagtccaaggagttggggcaagtagggggtaaccaggcaaagcttgagttgcaagaagacagggatattggccatcctggtcattgtagtcttatcaggtccttgtcccttgtggaggcagaattcaccacatgttagtttttcctgctgtaatgaacatgaacttggggttggtgcactgatacaataaggtttgctctgctgcagtagtgttacctcagtgtaagagaaacaaaggcttcaatataacatttgcctgtgtatctcacagcctaagggctaacagagcatctgtgggaacacagtggcccacaccctagtcaggaccccacaaggactgaaccaaatgtagggtcattagcttttcctggcctcaaataggagtctcaccctgccttagccatgactcccacgccatgtacatgtggtaggggcctgtgtgcccagcaaggacacagttcagagagctttcttcattacctagggtgagtggctggaaaaaaaaaaaagttgcccacgcccatgaggccctggagggaagcatagaacctactactaaattcttctgggctgacccattcaggcatggtttcctctgtatcaaagttgctctctcactgatctactgacagctagctcttaacaaaagagtgtgtggagcagtaaaactcatgtcggcctgagagggccccagacatgtaatgatgtctggtggctttggctcgggccaccccatggctgtcctccttcttgggcgttccccgctcccatctcactggagccatggtgggttcacctgtcctctcttctcactcccattcttcagggtgggatgcagtggtgtgctcctctctccccaacagagcactgggtcccttttggagtctagtttctcttttcacccccaagcctgctggggaggtctcaattccaggaagttggctgctgggcatccactataggctcgagccctggaccacaggcgctgtcatattttgggtggaaaggaatttgtttcttttctgcaaagtaaaggaaaatggaatgagggcaattaggttgatctcatgatgtccatgggtccatgggaacttgaaagactcatccccttccccctgctttaagaagataaatggagaaaaggagctcccattaagggaaaacattgactctattcctattgactctatccttgaaatggaatttggattcaacttcaaaattgaattcatttttagggatagagtcaaattcaaatattgactctatccctgaaattaaatcacgagcaaataagaaatttatgagatccaaactaagccatttaagtaaactattccagaatttaaagctcagcaatgacaagatatcaggaaacagtgacaattctcccactccacaggtgagtccagtgagactggtcagggcttgctgcctgctccttggtgctgtcctggtactttggaagcatctatgattctgtgaacctcacccacagctgcccagcaacttccttttgcttatatgagccagactctgcttttatggcttatactcaaataatttaagttatttatttatgagttatacgtcccatgtggagatagggaaggagagttaggtactcttcaatgttactacctgctaagcatatatacatgattttttttttttttttttttgagacggagtctcactctgtcactcaggctggagtgcagtggcatgattttggctcactgcagcctctgcctcctgggttgaagcaattctcttacctcagcctctcaagtagctgaggttacaggcacccaccatcatgcccagctaatttttgcatttttagtggagacagggtttcaccactttggccaggctagtctcgaactcctgacctcaggtgatccacccgcctcggcctcccaaagtactgggattacaggcgtgagtcatcatgcctggccgaaacgttgctttttaaaggtataattttggattagagcaaatgctagtgtatttaagtaaattccatgaagaatgtgaacactgtaagcaagtgcattattctcagcttccatctcctcacagagccatcatccactctcttccatcctgccccctacactgggaggcaactatgacagacagacgacatggcctgtgctccttcaccatctggcttgtgcttgggtgtggatgataacaggcacctgcaggagatgggagtgtgggaggaggagtaactcagggttttcatttccctctcttactctgggcagctctgtgattctgtaatcacttcaggcctctatccacagccataggcatgccgggctgcccctagtgaaagctacagatttgccggagttctagaaactgctcccttccttgctctttcaagctcagaaatgcaaaccatttcctgctacagatcatcccagggagcttcagtgccccttgtgactttcttagccctgccagaacctctttaaaacgtgtcttccttctgtgccatctctttcctgccaggacccagaccacagggtgctcccacagaaaaagggacaagaatttatttatgacatggcaataacatatctattcacaatgcgaattcaatttgttttggaagagactgggtcttgttatgttgccgaggttggtctttaactactggcctcaagcaatccctttgccttagccttcccaaagtgctaagattacaggcgtgagtgagtgtgcccaggccttaattcaaaaatttgacttactacaataaaagggaaacaatagaagcattctggaaatggaacaggaaagaaggcagaggtgggaacgatcaatctgtgtcatctgagaagccccatgtgcagaggctgtcctgggtctttaggggacgacaacaacaaagcacacaggatcctggtgtcagggacagagcatggccactgtgggacatagcggctctcctacaaaataatgctcatatacatcccttatgaggaggatcagatcaacatataaaaatatgccagataaagtggaggcgagggcaggatggagagctgccagtatctgcccttgacctccatggacttgaagaaaggctcagcctggagttgtgtgaggcctccgacctggagcagcacccacccctaaagaccaggcaccaatcacaatgcaaggagagatccagacaaataaacaggaaatgaccacagcaggagctttgttgagcacagagcgaggccacacaccactcagcacctggccctccacccgcccttctctccccacctgcccctgccccagcacagcagatcctcagaatccaaaaagagaacctaacctccatgttttattaatggctgataatattttaccacagcttcaaagaaatgatatgagaacaataactaatagagtaagaagtctattcagggtgagtgagtgacaagggaaatctaggaggcagatattataaccctttcattcccagaaaagaaatgatggtccagggagatacaccaggcctggatattgagattatgtggaaggggttctggggcatcagaggagtgggcctcactcccaccatcctccccttgctatgcttgggaggagatagagctcatcagctgcacagctggggaaagagaagtcagggtcttccaagagacaaggggagctgtgaacaatctgtgtcttgctggtctgcacaaggcagctctcaaacagtggagaacatgctaatgagcagattcagctcagccactctcagccttgacaccctgagcattacagacagcccatgaccaacccctactttcaaatccaaagatcccctacagcttgaagctgctccccggcctcaactcctgttggtgttgggccccaagggtcatatttcaggaagctgtgagcaccacatcagcatcagggacccggtcaccacctggagaatgataataaaaagacccagcagagcctgcaggaggagactgtatttgaggcaggaccatgggataagtgaggaatgagacggtggctccatcctgtctatttcaggagttagagatgagctgcccctaccgccctttccatgctgctttttattgagtagacccctcctgaagttcttttgaggagggaagaccctgttaggtgccatggtagagaggggccctgtgagtcttaaataactggttaatatagctacttagctgaaattaggaaggtaaacccaggattcaggagaggagaaagagacagcatgggatcctgcagtcaccctcctgtacatctgtttgcagggagggtctttcctgcagggttgggagcacccagtattgaggtcctctgagtatggctaccctattgttctcatctgtgaatggggccaggcctgtttcttcccccagtataaacagccaggggaatccatccacaaaacacctgctagcttcacattaatcctgtattagtttgatttaatatttcatatcttataagaaatgaaatggaaggatgatctctttggtaaaggtaattcagatttctggggccctggataccttatctcactgtttaaaatcctcatggaggatcaggagagtacagagcccagaaacagtcacgagacctgaagctccctggtgtaaaggaccctcccccacaccctggggcttagagtgaacagcacagctgactcccagggtctgcaacctctggcctctactgtcagcctgattgttctcagtcttcctggctgccaagcttctggttcccagcagcctcctctctcacccttcacctcttctgactggggtcattggccacttgacaggcagtgccctccttgtcagtcagcctgtctacctggtttcctctcagggtgtgtggcttgactgggttaaccatccccagccccagcagaaacagggagaagtgactcagcaaatcccccaagagcagcgggatccctacatgtgagatggggcaaagccatcattctagtccctcccatacctgagaacttcttgcacatcacaagtccaaggaccatagcaggaagtagctctaagccagagacaagaacagagcagtgacaagaggctggtgtgaatggagaccagcaagctctattgagagtagtgggatgaggccacagatgccctgtgttgaggggctagtaggaaatggtgggagactgggatttcattgcactaagaaaggaagaggatggagtgtctgtgggatgtgatggtgaggatgtgccgtaattcccatttgaaaggctcgctctgcctgttgcatgggtgatggacagcaggtgtgagaagcagcaggcagcccagctggaaggcccatctgatttactatcctagagaggattggctctggggtaaagtagtagaggagtgagaagtgattggatttggggtcaaatatttaagatggtgttagcaataagtcaatggagaatcacacatttatttacttaacttaattctacagttcattcccaggagtttacagcaacaaacccatggtaataaatatacatgaattattttaaaaacaacaccaaggaaaatataaactttagaatgttaaggctggggtaaagctagcacattgctaggcacgaaggagcatctgaaacatttgctgaaatggtttactgtttacctatccatggatttgttggctcacaattttattgcatcagagcaccatggagaggggtgacagtgcaggtcaccaacccttagttttctgcttcaggaacagttccttgttctacacttagagtcaaagcaaattacgtaactgtaagatgttcaaagatgaagtcaacgaatgcaaagtcagtaactaagtataaaacctcccccaaggagagtctacatttcttccccagaaatggcctcactgtgcactgctgaagggagagggtcttttcaaagagcccaagaagcaggggctactgggctgcagctctaaatagagatgccattctttctacctgcaggtcctgccaagcctaacagcagacttcagtgatcccacctgaaccaggaattcgggatttttgatgctggttctatttgagccattgtgtaagcttaaaaatgtgacatggagattttgctgtaattgtttctttgctggaatttgacatccacggtgcctctggcttcctgtctggtcccaggagggaatggattgtccagcactttttttcagcatctctttgtggaggggggatcaggagatttggagtcaggggcccctccaatctcaccctcttctctaatgcagagtcccttaagctttctggggtgggggcgttggcactctgcggatctgatgaataaaattgttccagctcctgaaataaaggcacaggtgcacataaatacactgactcttgcatgcagtgccaaggtgagaaagtttcctatgatagatgccgagtttagcactttgactctccattaacattcacacagacacacacacaagcgcgcgcgcacacacaaacacacacacacacacacacacacacacacacacacatacagagccaaagccagcgatgcgggaggggctgacctcaggggcggggtcacaggcatccctcaggtccttctcagtggactttgtctctttttcctggaggtggaggagtctgtacttcatgagaagtcctctgaagaaagcaggagatacttaggagcggggaagtggagacaaaggggagggggcgaggcaagggggaagcacgcaagaaatggggaggaggaggaccttatagtggtcagaaaagtcacacgcagaatttggctcttggtttttgtgtttcattaggatggacttagaaaaccagacagagtgcgagataaggagtctaccttgcaaaagacacgtcttagtgtcctcctagtttgaactcatcagtagtagctgggagaagggagccgggacgcctgtgtggggcacgccctctctagttgttcccattctctgcaccccaccggctggtgcccttcaaccccaacaggaaggaaaggaaggaggggtcggaaggctttgggtcttccctcgcgcgccttcttcctctgccatttattccctgagtgtccttgccttccctccgctacctgatccccaccttaacaaagcacactctgcgctgttgggccaggattcctcctttggcctctgactcactggtacaatttcgctgcgtcctgtccttaccgcagttgctactgggtagagccggagagagcatcgcccagacccgctagattcatgcagcgccactgcccgcacattcttgacacttctttagatccaaagtcagagcctgagttttcagactagttccgaaagcctttagccattggaaaggggaaatcaatactctaggaacaaaatttgcttcgactttgtctcaacccaaagacaccatgacggcgcagttttcaaagttgctttgagtataaatggaacagggtctcctgtgtcagactcgattttgcgtttccctctttattatagcccttctgtaaattttattacatgtatctctactccactaaaaacatttctgtcaaagacactaagaaagagtcaatgccatgaaaatatgaaggatactcttaaaagagagtttctggtgttgagttttaattaacactttggtatttaaaaatctctaactatttgggtttggggcttagcttcataatgtttcaaactgagatatactcttccttaacctccatacaaattcaggtttatttttatttttaattgcatttatttttctttttttgaaacaatgtctccattcgtcacccaggctggagtgcagtaacacaatcatagctcaatgcagcctcgaactcctggtctcaagcaattctgcctcaccttccagagctgaaattacaggtacaaaccaccgggccaagccaaatccaagttaatactgtaatataaaattccaacatttcagagaaagtgaaaatcaccaagttattgtagtccctggagtcactgtcaagactttggtgagggctcagtggctcacgcctgtaatcccagcactctgggaggctgaggcgggtggatcacctgaggtcaggagttcgagaccagcctgtccaacatggcgaaaccccatctctactaaaaacacaaaaaattagatgggtatggtggcgagtgactgtaattccagctactagggaggctgaggcaggagaatcacttgaaccctggaggtggaggttgcagtgagccaagatcgcaccactgcactccagcctgggcgacaagagcgaaactccgtctcagaaaaaaaaaaaaaaaaaaaaaaaaaaaaggccaggcgcggtggctcacgactgtaatcccagcactttgggaggccgaggcgggcagatcacgaggtcaggagatcgagactatcctggccaacacggtgaaaccccgtctctaccaaaaaaaaaaatacaaaaaaatacaaaaaattagtgtggtggcgggcgtctgtagtcccagctactcgggaggctgaggcaggaggatggcgtgaacccaggagaatggcgtgaacccaggaggcggagcttgcagtgagccgagatctcgccactgcactccagcctgggcgacagagctagactctgtctcaaaaaataaataaataaataaaactttggtgagaaatcttccaggtttttccctacttaaaatatacattatggaagtggtattactggcattataattcagtgtatcctcatcttttaaaaaatggttaaaagtatgagacgcacacatcttctcataacaatacttaaaactgatcttacctcttttattgaccctataaaattgtattgcatagcagctctttggagtccgatggaaatgttctacatcttcattgtggtagtggagatgtgggtgtgtacaacagccaaaacacaacgagctatgcatttcaaatagatacattttagatacattttattgtatgcaaagcaagtcccaataaaatggcttttaaaatatatcttctttgagatttgtactttgcttatgtaaaacaaaacaaaacaaaaaccttgtttttgtgcccaagagacacaccctgacacatcggcaggtagaggcttacgtgtatatatattactgtatatttacagattcagagagagagacagagataaagctatgttaagaatattcatacataccaaaactagataaaaaccaaaaataaaagttagaaataataaaactctatattttaaatgttattctcttcttcaccttttttctcctctttccttcctctctcttcccttttttcttcaacacgctccccccacccccaccccccagccatccttccctactttctcccttctctgcacttgatccccggtgtattccagcctcgaggccaacacacgtcaccgcgtccgcctggggcaggtcggggaagggacgcgaggcggcgctgtcaccgcattctgagggccgcagcgccctgcgcccctgctggtcttgtatcatttcagtgaacgtcgctccagtctttgatggggccacactcgggatgtaaatttaggatcctcactgaaggggcgggaccctgagaggctttctcctggccccttagttgtgagttttcctgcaggcggaggagccagtttccgtcagaaccgcccagaggcaggcgctgccttcctggggtggcggagcagctggaagcgttttcggatcctggaatccgtgggcggcccgtgggaggggctgaggcgcatttccctactcacccggatccgaatccaccgcggtgctgtttcaagcgagtcagattccacatcgcgctccaccccggactcggaattcctgccccacaggtctgcattttcatagcggcagctgtgagtgccccgcggctggagaccagaagcctgaaggcaactccgtcctccccagcccacagcgccgttattccgtttctatatcagcaaacacttgtagaccagggcggggtaacgggtgatctcagtcctcgcagtgaactccgggccgcaggcttgaaaacgcgcgcgggcgcccagcccaaccccgccctgggttctgtaagcgaccgcactgggtcctttctctttcttttccggacccagcagtggcgcctaaagtctgtgaggagaaagtcgcctctgtgccccggagttcagaggtctaaggcgagtcctgaggaagaaaacgtagttgatggggcagagcagaaggggctggaggtggggtggagggagagggcattggacagaaggcctgggagacttggtgggggatgggcagccaggccgggaccctggggagtgcctcaccccgagcgagcggaagaccatctgggcttcccctagcccagaaagggtggattggcttcacctctgctggccatcacctctacatgccttggaactaaccttgtatattattattattgtcgttatttaagtattaaaagtattttttgaggtgagctgaatgagaccctttgctagagctggcacagggaggaaggtcgtcctggagggagggtagacactgtggagggaagggagacctgtgtcaggagagctgagaccacctctctgcccctcactactcttgtaatctttaggagtgtaaataatccccctaaggtggggacaggaccccagtccctgctgtgcgcaatagattatgatgatcaaaataaataatcagtgaatgtggatgggaaatctaagtaattgttaaaaccctgtgatgcttaaattttcactcacagaaatgtgtaggctaggagttttaagaggaatggttagtaattataggtatagttcagttttaaaaaatgtttgtaagagtgacaaagatagaatgaacacagttccagatcatggactgttcatcgtgtagtgagggatggtacaagatggtagatgacagctgggcatggtggcactcacctacagtcccaggtactcaggaggctgaagtggctggattgcttgggcccaggcatctgaagctgcagtgagctgtgatcacactgatgccctccaactggcggcagagtgagatctccccctcttaaaaataaataaataaataaatagtagatggagttcaagaatgcaggcaaagttggtacccatcagggaggttcaaaccatgggctagaacagtggttctaaaacttgcctacacattggaagcacgtagagagctttaaaagatattgaagcttaggtccaacctagccttactgattcaattggttttggctgtgacctgggaccgtggatattaaaaactctccaggtggttctgtgaagtggctaggtttgaggaccactggctagatgttccaaagagtaagagacgtgtgtgttggggacgagatgattctttcagtagaaagaggcttttgcatggtgttttattatcgagatataatttatgtgccacgtaatttaccatttaaaaatgtacagtccagggcccactcagaaccatcccagcaacctgaccacagctggtctttgctggacaccatgaaccacactgcccaaaccttcttcattcctgccaacagtggctgccctcccccgccccccaaccccagctatgagatgctcaaggaggagcatgaggtggctgtgctgggggcgccccacaaccctgctcccccaatgtccaccatgatccatatctgcagcgagacctccgtgtctgactatgttgtctggtccctgtccaacatcctcttcatgaacccccactgcctgggattcatagcattcacctactccctgaagtctagggacaggaagatggttggagacctgactggggcccaggcctatgcctccactgccaagtacctgaacatctgagccctgattgtgtgcatcatcatgaccattctgctcaccgtcatcatcctagtgttgatcttccaagtctgtcgatagatcaggaggcatcatccaggccaggagctctgcccatgacctgtattccacatactccaacttccattcctcgtcctggccccagagctgagttctgtatcagcgctttatcctcacacactcttctacaatggcattcaataaagtgcatgtgttcctggttaaaaaaaaaaaaatgtactggtcagtggcttttagcataatcacaacatcgtgccacagttgctattatctaattgggaagattttctttttttaaaggctagtcaagtaaagcagtgggagcggagaaggaaaaaagaaatctgtaattggttgtgatcaattagttgtaaacaccactacactctgaccagcctaattgggaagatttaaggatgtgacacggtctaatgggctcagaggcagaagcgacagtaatctggaagcaggagactgcttaggcagtggcatcccggtgggacagggcaaggagattggggagcccacttttactgcaacactggaaagagggatgtcaccagaaaaatgggggtggtgacagacaggaggttgtggcagctgtggcttccatggtagagacctcacgtgtgacattcagcagatggggtgctgtgggggtcttagagcactctgactatagctgggacagtcacagtgtttaggaagcctgtacagtgatctaggctgaatcttgtgcagtgatctaggctgaaagccgagactaaagtagtggctgtgggatcaaaatagggttggaggagctttgagtacttgagaaggaaaagggggaaatcagaaggcaccacggaaagagaaacaggggaggaagagaggatgatgtcatgcgagacgtgtagagtgtccttgtagacctgtcacattggaagctactatggtctcagaggtacagatgtcctaaagcaggctggaaaagggagtctggggagagcttggtgttggagtggacactggcaagctgcctccttggccttttgatcacccaggggctgaatagagaggcagccccgggagacctcacacacttacaggaagtgaccataagaaaggggacctagctttgagtaaaagggaggagaaggagattgtaaagctgaaacgtctaagagatttgtcgtcttagcggatcagctggggcaggtgctacagaaacagaggtagctgaggtctggaaacaggtctgcaaatctggtcactggccacatagccagtaacgctgtgcgcggctgaggggagtgtgttggaagaataaccaggcctcgtctcttctgtaagtgtgtcctggaaagaacaagcgaatgacagtcagcttgatggggtggctggcgaaacggtcttggtgaggcacgctatcctaggggtgggggtgcggggatggggtggtcgcaatacagggagggcggcagggcccaggtcgtgctcatgcggttggggctgtactctcagctgctcggagccagtccccgcatttggcggcgcttccgcgcgctcccccttttctgggctccaggtcccgccagccaaagttctccaggtctcctgaccgctggaaccttccccttctgagtgtggccccgccctcccagctcgtgattggccctaagctgcgggcgccagttttcattgggtgagcggtcgctggggtggggccaggtgacaggaaatttctggtgggccttcgcggctccgctgggttggcagccgcttgagccactgcgaggaaagcaaagtctgggccatggagatgagcctagtcctgctgttcctgatccgcactgccctttttgcaccccagggagctgctgctggtaagtggggttcctggcggtcctcggcggagcggcagcggcggggcgtttctgggggtccgggtgggtagcggcgagcgctgtgcggccgaggcggggctcaggtgcgctgtcgggggtgcggggagtggacgcggcccgttcccgccacacctcaaccctgcttccacgtctcttttcagtcctcctcgggatcgctcatcacccgccccctgcattttctggtcttgtcctgcactttctctcctctcctctcctccgtctcctctcacttttcggacaaaccagtctttctgaggcccctgggttcctgggctgctcctgtgaatggcattcgagggcccttccagcgcggccgctgaggcagccacctcccccggtgctgggggcggccctaaggtccctgaagccctgtcctctcccggagccgacgtgttctcagctcctgggccgcatctcctggagttggggccctcctttctcgggacccggagctagtgcttcctgctgctgtggggactgtggggctcctgaccctcacgctgaggggttggagtctgcaggctccgggcagaggattcttcctgcgacttctctcatccccagctcattctcccctggcctcccgctgccggggatcctctcttgtcttgcatccttccctgctactattaactccagtgatctaaggacaccagattccctcccacctcctcccctgccctcagggcaccttgggtcctgttgccctcccagctccctgttaccccttcctatctgcagttctctgatacatttctaggatgtcctctgcctcatcccctgcccccgccaccgcaggtccctcctgcctcccttatgggcctttcctagaagcagccttaacccagggctgcccctatgcctcccactcccaactctccctgaccctaactctctggtgccgccttttgtcccagggtcttccctccgtcccactcccctctagaccacccaaggggagccctagtgctaatgttggttgggccttaggcagggcacagggcagggcagatgccccctcccctctagtgcaggtgcctgctctgggccctgcctcacggtggccccttccctactccttcatcctcagccccaccctcttgaggaccccccactccagcccacgggtgctggaccatccctccctggtccctccgcccctctccgccttgggaccttgtgctgctcctacctcttgcccagctgccttgggccctcagcaagttctcatctttcccaagccccaccctcactcagagcaccctcccctcctgtcctcaccctaaccaaagttcccccagggtcacccccacaccatgctcaccccatcctccagtccttgccctgcacatctgtcctcctctacccagacccaacacaggccgtgtgtccaactgcttcttttttttttttttttttttttttttttttagacggcgcctccctctgtcgccaaagttggagtgcagtggcgcggtctcggctcactgcaagctccgcctcccggattcaagtgattcccctgccttagcctcctaagtagctgggattacaagtgcccaccaccacacccggctaatattttgtattttaatagagactgggtttcaccatgttgaccgggatggtctcaatctcctgacctcgtgatctgcctgcctaagcctcccgaagtgctgggattacaggcgtgagccaccacacctagctggtaattcattttttaatttttggaggaatcaacacactgttttccataacaggtgccctattttgtatttccaaatgcattacacaaaggttccagtttcgcaacctgtttgccaaacttgatatttctgtgtgtgtgtgtgtgtgtgtgtgtgtgtgtgtttgataatagccaaactaattggtgtaaagtaatagttcattgtggttttgatttgcatttccctaatgactgctgatgctgagcgtcttttcatgtgtctgttggccatttgtacatcttgtttggggaattggctatgcaagtcctttgcctacttttgtattagttgaatgtctcctgtttgagttgtaggagttctttatgtattctggatattaatctcttatcagatatatatgatttgcaaatattttctttcattctgggggttgctttttcactgtgtttattgtgtttttaatgaacttttttattttgatgagtccaatttatcaattttttctttgttgttgtatctttggtgttatatccaagaaagtgctatcaaattctatggcatgaagataattccctatgttttattgtaagagtttttcagttttagttcttgagtttaggtctttgatgtttttcttagttaattttcatatgtggtgtaagttagggatccaacttcattttttttttttttggcatgtgaacatctggttttcctagcaccatttgttgaaaagatgcactgactctttaagacccttgccaccagcccaccccaggggacaccaactggtccatccacctccctacttggggcattgccatgccactctgaagcccacaccattgcttctccctgggatacggacctcgtagaaaacgtctctggcaccacagcctacctgcccctcctgcctcacagccaagtctcccttgcccccaccttgtccatgttgagccttcctcaaaggcagtggaccttgcctccatctcaccctcacctgtgcaccacagccatggtggtcatgggtccctctgagcctgggtcccttacagtttctgctctcccctctggcaagaccttccttccaccactgccttcatgctcctcccttgaacctgcagggcagccccttccattggcctcctccctatatcctgagggggcctgtggctgccctgccctggcacctggcctacaagtttgccatccccattcccccttcttctgttcctcagtcccctcctctatcctcccaccttcccagttttccttgcgtctgaaatcctcattcttgtccctttgcccgtgtgcatttcctgcctcctcaggaaggtcgggacagcagacctgtgtgttaaacattgatgtgaagttacttccaggaagaagtttcatctgtgatttcctcttccccagagccccacagtctttgttacaacctcacggtgctgtcccaggatggatctgtgcagtcagggtttctcgctgagggacatctggatggtcagctcttcctgctctgtgacaggcagaaaggcagggcagggccccggggacagtgggcagaagcagtcctgggagctgagacctgggacacagagactgaagacttgacagagaatgggcaggagctcaggaggaccctggctcatatcaagggccagaaaggaggtgagagtgggcagtgggcaagagtaatgggagaggccttttccaggagagttgggggcagagagcaggacctgtctcttcccactggatttggctgtgagtaggggtgaggaatggtgctcagcggggctcagcccacacagggagggatggaagagggccagggaggggtccttcctggtccgagttcctcacttggactggaatggagaagtcactgctgggtaggggcaggcagccttgcattccctccaggagattagggtttgtgagatcaggaagccagcagcaccaggggctttaggcatttctacacatatgggaagctcttcctctctcccaacctggagactcagtaatggacagtgccccggtcctccagaactcagactttggctatgaatgtcacaaatttctgggaggaaaatgccatgcagaccaagacacactattgccctgtgcaggcagactacatgcaaaagctatggtgatatctgaaattctggaggtatcagaaaaacaggtactgtgaaagtagtgggtcctcctatagaagcctgaacctggggtgggcattaggcaggaaaggaaggcctcaaggccagggctgcctcatttgcctcccagcctgcccatcctggagagctacctcctagccccacgacccaggagcccacccctgacaaccctctcctcagcatcaaagccggagtcccagagtgtgaggccacagtcctgaggcccatcttccagcaagcctaggggaattggaccccaggtaaggaccgatttgcagaaggtctggggtcagtgtgggtttcagcgagagtcagaacaatagagaggaccagtcctgttccctgcatctcccttagaggggagaaaggcttggccacatgcctcactggctctgcccttttgtctccaatgacccccacagtgaatgagatgcacagtggggccttagaaggcaatgtcaccatgatgtgctggcctccatcttctatccctggaatatctctctgacctggcatcaggatgaggcatctttgagccaggatgcccagcagtctaggggtgtcctgcccaatgggaatgggacctaccagacctgcatggccaccaggattccccgaggagaggagcagaggttcacctgctacatgggacacagagggaatcacagcactcaccctgtgccctctggtgagcctggggcaactctcaagggtttcgacctagggaggtcaggccagggtggggatagcagggacggctgtggctttgcgtgctcagtgtgtcacaaggccctttttttagagaaggccctggtgcttcagagtcaatggcagccattctgtatgctgctattgctactgtcattattattagtattagtagtagtagtagtattctctgtgtcctttggtgcaagaagaagacaacatcagctgcagagtccaggtgagaaaacggggcagtggctggagatggaaggactcctctctgggcagcagggtcccctcatagctcctgcacagatagacatgtaggtaacaaggtcctggaacaggggatggacattggggtatttgggaggggaatgggagccacatctccatctacacccctaagtcctgcccaagccagggctgggccacggccctcaaatgtccagcggtggcctcctcctgctgcaggtgaggagtgggcagcagggagggctgtggcacctgctctgtccccatcctggtctctcttgtttcttgggctcaccacggtgcgtccaggtggggtgagttgagaatcacgtgctgattgctgagggcctggatgatcatggcttcagtgggagtaaatagtaaaggcggctgtgatctggggaggggctagaaactggagaggaatctgaggagaggcggtgcccctagtctcttcctctctgcatccctctctcctgtttctccagccatcaggaggacaccaagaaaaagacccacgaagcccagactgggaggcctgcctgtgcagcccctttgaggtccccttgtaacagggagggtcctgagtgcacacagccatctctgtccactttgcagctccccatgggcctcctccaggagctgtcttgggggtatcatgtcctctgcatcactggaggttcccaccacatggccctgcctccctgagtttctgtgcagatgttatggaggagtatataagcagacatccctgggccatttgggaagcaggaaccagctccttgtcagggcagctgtggtccctattttcatcatatgtccaagtgttaccttgtctagcccccaggaacacagtccccaggaccatgttttttggggcacccacagcaggggcagtgcaggtctggttgctcctgctctcacctgcagcatctcccgtagaggaattgtcagttctggttccctgtgggcagtaaaggtttccttgtaggtcactggggcattggccagaaaaaggttgtgaaaatcacatgctaatttctcaaaattcctgctttcaatgttgatgtccaataaagatgttcataatttcagctggatattcttaataggatttcctccaataccgatgctgtaaagcatattgaatggaacaggaattcaaatttgaaactctctctctagaagggtccatgtgggagatggtggctgtggctgtggcaatccccaggtgcagagtgggcggaggcagcctcaggctgaggggtctcaagaaatcccttattccatagggagaagaagaagatcctctgtgggtgtgagggcagtggcctgggtggaatccctgctaggaaccagacaggaaggccttgcagcctcaccaagcagcagccctggggtggagctggatttccagggatgagtggaccaggcaggagcagggcatcccaagtgcaggtcatggacctgggtgtcaagggaagcagagccttcttgagcaagggggtctccagggtcaggtcaggtgcagaccccatggcagccacgtgtttccatcctgggcctgacaggcctgctgggcttcctggtgggctctccaggtaggagctgcctgctcaggactggaaggggaggaacactgagctgtaggtggagggcggaacccacagtgggcagggcctgccctggtgtgcaggtgcttctgcaggaaaggagggcctggggaaagagggagagaaaggccttgtgtgtgacccagcccaggcctggaagtacgtggagccagggcctctctctggggaggcctcccactgtgtccgagctggccaggcttgagaggaggggagggcactgagtttcttctggagtcttgtcatttagtcctgcggccctttcagtccttacagagtgcatagtgggcacagggcaagtgctgatcttcatgaagtcatgggaggggactggcaggggctgggaaaagtgccataggagggagaaaaatgtgggagcatcatcttccctcagagaaagggtgaatctgattttggagtgactgaggagggagaaatcctcagggagtaaaaagcagcactctgcacccaggggagcatttattggtttctctattttctgcagagcacgtgagcctgcaaggcccggatcaacgcccggttgggacaggagaccaccagggcagtgcacagctgggatttcagtctctggtgtcaactcctgggtctactggctccactgagggcagctacactctgcagccagatggccagaattcaactccctgcccaggtctcaccagcactttcccacttggtgcctcagtttcctcatctatgaaatggggaaactaacagcatttatttcttgtggttgggtggatgaaaagcgttagtatatatgaggggtttgcagctgtgccacattatttttgttatcatttgattatattttaatatattacatatgcggtcattgtattattattataaatgagatttatgagtgagtgtcctggttacggctccttctggggagcccaggaccagctttcctggcaccttgaggtcccctcaccctgtcacactctcatgcattacctcatatctactatgtcttcataattttatactatagaaatttaccctttaagtagacatttctggtctgtgttttatttcaagtgtctgggaagggatagagtatgaggttcaagagagaaggagaggtctgtcttcatgccttgacacagcacaaagaaatctccccacctcccccacatctccccaccagttctcggtgatggacagattcacagcaacacagaaagggctgggaagggatggagggggacatctgcagccagtgtttaggggctgaccctgtgggaagacacctgccttgcagaggacctctgcatcttgcagatgcagagctgaagtctgatatgagggagaggacagggagtgctttggactttcctgattaagaagaatagagatcagtctgcttctggggttaagtgacccctggggagattggactgaattaatgaagaataaatgaactgggaatgaggatgagtaaagcaagtatcagcatctcccattatcagttcagactgattggtagatggggaggtgggatagttcctgaccctgttgtgaggttccttttaactttctggccttggggcacagatgggtggtgctcttcttggtcagggtagcctcggctccactcaggtaaggcagtggtggcagggagagttatgggatcacctgtgaaacggaccaaggcagggatgggagccctctgtgcagcaaaagtggatgcaaggcctgcctagaagcaagaggatgaaggaacctagttgggtcctggtccactgcctgcctgtgttcacaggtcaaccagtaaaggaggtggggtagagaattcaatcgtgggctatctatccagagatgtgtttacaggtgtattatttcacatttgtgttcacgtttggtgtcaaaaacacatttatacatgcctatttcatgtttaagtattttcacattttagttaacccttaaatatcattgttgaatgcggttgtcattagacataaacttgcatattcactgaagcttttgtttttattttaatcaaatttataattgtgcacaattgaaagagtcaaatatttgtgcagaatctcttgagaaaaatgagagtcctctctgcctcttctcaatttctgcctttctaggggccaaccactttcaagttttttagctgattcttttgactttacttctgtatctctaactaccatttctttattattattgcttgatttttttcagatgcacccattgttgcacagcgcaatggtggatgcaacagttaagagtacttgttctctttcactcttcccagtatatttatatagtgattatgtttagttcagccatctcttgtttcttttaccatgactaatcctctcatatgtcaactggactacttttcactgcctgtacaacattggttcttcttggagttaatacttgcatttgtttttgtttattttattaactctcattaatttaagtttgatatctcttttgtttgtatgattctttcaagacgttggacactttggacattctgttaattttatcttcttggaaatgtccctcctgggcccttctggctgctcccatctggactggaggcttctccccgtggagcagagtcactgtcctaggatctccctccatcactatctgggaaggtgctttacatgcagtggagccacctgggttccagccaaaatgcagactgattcaacatgtcaaggctgggcctgtgagcctttctgtctagtttcaggaggtgctgattttcctggttcatgggtgatagctggggtagcagggatctctctttttgtctcatagttttctgtatctaaggtaagcgcatactaatatatttttaatgaattcatgtactttttccctaaattagtaacagggctaattagtcttttccttgggccaaaaactacattatgtaaaatttggtatcttaactattttaaagtatacagtagtacagtattaactgtaaatacatagttgtgcaacagatctctagaacttttcatcttgcaacactgaaactctatgcccattgaacaaacattcatccatccccctcaccgagcccctagcagccattagtctactttcagtttagacacctcatataaatggaaatgtgcagtattgggttttctttgtgattggcttattttacttagcagtgtccttcaggtttatccctgttgcagcctgtgaccaggtttccttcttaaggctgaatgatattccgttgtcgatatataccacattttcttcattcatgtgttggtgtgtgttgtcttggctatcgtgaataatgctgctttgaatatgggtatacaatgtttttcttttcaaaccttccctcactttggtggaattaatcctttagtagctacttctgacagcacatatttaaagtatgtttgtatggttcaatttttccattgtttttattctctccaggaagaggagataaatatatgaaggtgctgtttggcacagaatttaatagggaagaaagagacagtataactcaccagtgctgggtctcatcatcctgcaatttcagaacaactatgaatacaaaaagaattttaaaatcccagtcctgcctagaaaggggaagtcatctctaaatatggtggccctggggcagctggcctccctgccaggcctcttccatgggggccctttctgcagtgactgtggtttcttcccattttactctgtcctgtgtcctgactgaagcgacaaggtgtgtctgcagctgtgctcacacctggaggaaacctcaatggtgtgagtaaattgtaaatgtttacttattatgggttattttattatttatgaagtatgtattttgatttcattctactgacaacacaataaaccaggacatgatgaccctagcagcacatcctctttcctgtgtcaagaagcatcgtccggggaggtgagaagaagacagtcctccctagaattgaagaaccagggagaaccagatgggctgggcaggtgggttttcacctggaacctggaggatgagcaatgacatctctccaccctgagctcagccccggcatccacctcctgggctcatgagcagtgcagtggtgcctcctagtggtctctgctcttccttttccagatcaagcacaaacctgagatccaactgtccctcttatgcgcctgggtttcttcactggacaccagtatgagtcaactttcctgtaaagcagaacaagcacgagattggaccatgttagaggaggaatggtgtcatctccacttctggagagatcactgtccccgtgtttgggggaaggaccaagcctcactcccatgcagagaagaagctctgactgtaactgcacctgtggagaggtgaggacctgtcccctctacaccgatggccagagcctccagagtggggccaggcttttccctcagctgtgtcctgtcaggtttatctaggcctcaaagaatagaccctggacattgcctctggcaatgtgagctggacacacacccagatgtaaggtagccctgccaagtatcctggggttgccagtagttctgggtgctcagtgtctggagcggagggtgggaaggaggcttgatgcagaacaagaaccatatgtcacatactattttattctttattagtgtttttgtcataaaaaaccccacgggtaccataaaagataaaagatctaaaaatggtgccctttaatcaaaagtaaacaccctttaaccatcagagagagggagaagtttggcagctgacctagaagccccatcaactgccccagctcaatgataaactcttctcttcttcaaataaaagcacatcctggcttacatggccatcacttctttgtacaattttatatttttatcatctaaagttatagtttagttttacctttaagagtatatttttatcctcatttattccatagattcctgcttgaaatttatattgtctggtagtttcctgtcctttgcattttgcagattgcaccccaaggtgtggtttaatgtatctctatgacctgtattttctgtaaattggtagtttgttatagaggtttgcgtctattcagggtttttttttttttttttttttttgccatgaggattgatggtactatatcatgtttttcatcaagaggaagaattcaatactagttatttcttttttgtgatgttaattgccattgctgttcagtggctaaatctgttaattcattacaaattgcaaaagtctcagtctttcatttcttttcatatactagctgcataatttctaaaataaaagatttaccctcttccaccagttatctattcagtagaaacttgttttttgagagactaaaccaagtttctaatcacctatgacccagcaattccactttttgttatataccaatagaaatgcatgcatttgtgtcccaaaatatatgaaaatattatttatagcagcacgatttgtagactctgaatacaacacaaatgtctatcaacagtggagagacaagaagtgtgagctatttataaagctgagcacctgactgccacgggagtgatagtgaccacacacagcaagacctgggacatggcagtgactgtgtccagaactgacagaactaatctatcatattagaaatcaagaaagtgtctgctctagggttggggagggtgatttatgaccaagtagaacccaatggtgtttcctggaggctggaaatgctattccttgatgtggctgctatttacctgagtgttcactttgtgaaaatccacggcccacttatggtttgtccacctttctccatgcatgttgtccttcattcaagtatacatttctgatgttttgaaacaattctctctaagctaatatagaatctccattactgaaagtccttagaaatgctgcattggaaaaaattagtccaattattaaaaatctatgaaataaatgctgtgactcagacattaagaggagaatctacaacaagagcagtaggcttgggagctaacgcaagaacagctttggaaatggctgttgagccaggaactaggaatcaaaacccaaaaaggcccatgcaaggtggagggtgtgaaatgatgccccagtagtgcatgaatgaatgagtcatgggcagtggctcatgggttgcttggtcagtcaggaacttgagcaaaataaagttggaaaactgggggatggaagagagaggtatgcacagacctcttgacatgggcagagcttcagaagatggtggttgcaggtttccccaaatagagaacatcaataaaaaggtagaaattttacaaagagaccagataaaaagtttggagctgaaaagtgcaataactgaaatgaaaaattcactagaggggctccagagcaaatttcaccatgcagaatggagaatcagcaagcttgaagataagacaattgaaattctctagttcagtagcagaaagaaaaaaaattatgaagaaaaataaacagaactttaaagatctgtgagacaacatcaagcacatgcactttgggagtcctcaaagaaaggagagagagaaaggagaagaatgactatttaaagaataactccaaaccttccaaatttgatgaaaaacattattcatccaacaaacttgacaaattttaagcagcaaaaaaaattaaatttaaagaggtccacaccaagagaacattataatcaacctgtcaaaagccaatgacaaacagagcatattgaaatgaataacagagaaggaacttttcaggttcaatggatcctcaataagattgcagcccagttttcttcagaaaccatagagttcagaaggcattggaatgttgacaaatttagaggtcagaaaaaaaaagactgtcatgcaggaattgtgtgtctggaaaaactctccttcagaaataatggattttatatatatataaatatatatatatacacacatatatatacatatatatacatatatatgactatacatagtactacatatatataactatatatagtactactatgaaattatatatatagtactatatatagtagtcatactataaaagctagtagtaatatgtatatttttggtgtttatatgtgtgtgtgtgtgtgtgtgtgtgtgcatatatatatagtactatatatagtagtcctataaaagctagtagtaacatgtatatttttggtgtttaattcttcctttgtttttcctatttggtttaaaagaaaatgcccattgactaatgaatgaataaacaacatgtagtgtatttctacaatggaatatgatttagccataaaaggaatgaaatactgatacatgctacaacattgctgaatctcaaaaacatgataagtgaaggaaatcagctacaaaaggatacatatttcatgaacccatttttgtgaaatcttcagaagagaccaatctatagagaaagaaagcagacttgtggtgacagggtctggtggcaggaggaaatggagggtgactgcttaatggtgcagagtttcccctgaggtgatgaaatactctggaactagagagtgatgatggctacataacattgcgaacctactaattgtcactgcattgtacacctattgtacaatgggtacagtggtaaattttgtgttcatgtatattgtatcacagtaaaaaagaggctgaagaatagattccaaaatcttttatatggtaaactcctgagtttgcttgagcatctgcccatctgtctttccccctcaggatgtcatctcctactcagagctcacccttgttcttctgtaagtagaaagcctttcttcacaacactcccagatcagccagacccaacccccaaaatgactttctgtcttggatccaaatgctcaggtgcaactctggggcaatttcagtgggagtgaagagattatccaactaggatgattcatttggagggaaatgtttgaccttatgttaggaaagtcatttgctttcctaaaaaggatcctgcttaccagtgagtatataatttttgtatgcccggggtggagttcacagcagaggaactaacaatagctctaggaacaccatacacctcatgcgtagctgactcacccatctgcctcccccagctgaaggaaggagctggattattaccttggcccatccatcaactgcatttcactggatgtgcaccctctacaagtgtgaaccttccagggttctcagttgctcttcctgctgttgtgtggcctccactggtgtggctcatgcccagggggcctgcaggagactgagtgtctcctaattctcaaggccaacattttcagtgagctcaaatgaagattttatgttctcagggactcatattttcatctgtggaagggaaaaatccatctcgctgtcttaggtgtgatggtaattttacataaatatatatataattatagtatttttatgtctataaatgagataatcagtattttataaattgatggtattcttagcattgacttcattgctcagctaaacgctgtaaccaaaggatgagtcatggagtggaggaagaatatttttctactctctggaggtgccataatcggcatttctgccctatggatttcaaatgagaaatttgctttaggctgaggttggaaggagatctgaacttctttgtattactattattttagatggggtcttgctatgttgtccaagctggagagaagtgactattcacaggtgtgataatagcacacgacagcctcaaaatcctgggctcaagtgattctcccatctcagcctcctgagtagctgggactacaggtgtgcactcagccacttttcattgttattttacttcaaatgctttattttgaatattagaaatgtgaaaatctatttgatcacagaagactttaaaatacacagatcaatgcctacttgaattaaaaaaaataaaatacacagaagaaataccacctaggtctcccctcaaaaatatcactgctattgtattgttgaaccttcctggactcagtgtgactgttggtccctggagctgtcctttgcgtggtgctgatttccattttgttggtggtggtttgtttttgttttcgtttttgtttctgaaacacaatttcactttgtcactgaggctggagtgcagtggtgcgacctcagctcactgcaacctccgcctctcgggttcaagtgatttccatgcctcagcctcctgagtagctgagattacacgcatgcgccaccaggcccagcaaattttttgtatttttagtagagacagggttttgccatattggccagtctggtctcgaactcccgacctcaagtgatccacctgcctcagcttctcaaagtgctgggattacaggaatgagccaaggcgcctggcccattttgttgttctctatgtatatatttttataggtatctttattgtacaaggttgcattcatatgtcatgggttatcttgaatgttgctttttgaatgtattattttacaagtagttttccatgttgtaaactctgtataaagtttacatgcttttttggccggcatggtggctcacgcctataatcccagcactttgggaggccgaggtgggtggatcacttgaggtcaggaattcgagaccagactggccaacatggtgaaaccccatctgtactaaaaaatacaaaaaattagccaggagtctaggcatgtgcctgtagtcccagctactcaggatgctgagccaggagaattgcttgaacccaggaggcagatgttgcagtgagccgagatcactgccactgtactccagcctgggtgacagaatgagactccatctaaaaaaatttttaaatttaaaaagttgacacacttttacaagctgcatcccatctcagataaggaggtgatgtaactgagttcttttagatccatctgctttcatcttatctttttgtaggtaatattttgacaagcatgtttgtacataaagattctcctgtggttgggattttaaaaattcatagactactcaggccaggtgcggtgcctcaagcctgtaatctcaacacattggaaggccaaggagggtggattgtctgagcccagaagttcaagaccagcctgggcaacatggcaaaatcctgtctctacaaaaaatacaaaaaaaaattagctgggcatggtggcatgagcctgtagtcctaggtaccccagtgtttgaggtgggaagattgttcgagcctggaaggttgaggctgaagtgagctgtgatcatgccactgccctccagaccgggctacagagtgagaatttgtctccaaaaataaataaattcatagactactcaagtgataaatattaaaccagagactgctttaaacattttaaagccttattatactgtcatactgtgattgtactgacatatttattcatttaacaaatacttactgagagctatttactgattatgatggtgagaaacaatggtaaggaaacagaccagatccctttatcaaagaacatacatttcagtgatactgactgtaatggttaattttaggtgtcatattgactgggttaagggatgcctagatagctggtataacattatttctgggtgtgcctgcgagggtgtttctggaagggattggcatgtgagtgactgagcggggaaaatcctctctcgctgtgggcagccacaatccaatcacctaggggcccagatagaacaaaaaagcagaaaggagtcaaattttctctctctctctctctcaatctgggacacttttcctgcccttggacatcagaactccaggttgtatggtctttggactcttgagtgttgcaccagtcaaccctttatcctcccacctcctcctctggcccctcaggcctttggccttggactgagccaggctactgtcttccttggttctccagcttgcaggtggcctctcatggatcttatcagcctccataactatgtgagccatttccactaataaatcccctcttgtctatctatctatctatctatctatctatctatctatctatctatctatctatctatctatgtatccatctactctattgggtctttctgtcttggtaaccctgatacaccaacagacaataaacaaatagaatctgtcacagtatcagtgataattgccactgataaaaaatacacctaggctagaagattggtgggagtggcgggaatggcagggaatagatttcagaaaaggtaactgggcatgacatttctgagaacttgaccatgggacatttgaacagagacttgaatggtgtgaggagtgagccatgtggacccccggggagcaggtgcatgtgggagtcacagcaggggcaggtagcagagacaggatggagcagtgacaaaaggctggtgtgagtggagacgagtgagctgggctgagaatggcgggatgaggccacaggggtcctatgatgaggggcttgtaggaaacggtgagagactgaggtttcattgtgcctaggaaagaaaagggctgaggtgttcataggatatgtcctaattttcgtttgagaggctcactctgcctttgtgtgagtaatggacagtgggcatgagaggcagcaggcagcccagctggaaagcccttctggtttacagttcttgagagggtggctctcgggtggtggcaggagaggagtgaaaagtgattggatttagtgttgatatacttgttaatattgtggtaaaacatacataccatgtaatttaccttctaaccactttttcagtgtacaattcggtggcctaaagcacatttacaatgttgtgtaaccaccaccaatatgcatttccagaacattttcatcatcccaacagaaactggacccattaaaccaaagctgcccattctccctaccctcaatttctggtaaattctattttactctctgtttctatgaatttgcctattttagctgcatcacataagtgaaatattatatttgtctttttgtttctggctcatttcacttatagtgttctcaaggttcatccaacctgaatttcattcacttttaaggctgaataatattccatgctatgtgcaccatgggtcgtttatctaatcatcctccgatggacactcggttgcttccaccttttggccattgggaatagtgctgctacgagcatgagtgtacaattatctgtgtgagttcctgctttcaattcttttgggtatatgcccaaaagtggaattgttggctcctatggaaattgtgtttttactttcttgaggaagcatcatactgtttttcatggtcgctgtaccactgtacactctcaccagcagtgtacaagtgttgtgacttctccacatcttcgccaacacttggactagtgaagttcagcatattttcatgtgcctattgcccatttgtatatcttctttggagaattgtctattcatgttgttcactcatttttgaatgagattgtttgtttttctgttgttaagtcatagttctttatgtattctggatattaattctttatcaggtatataattggcaaatatttcctcccattctgtgcattttcttttaactctcttaatagtgtcccttgatatataaaaaaggtttttaaattttgatagtctaatttattgtttttcttttattggttgtgcttttgctcaccagccaagaagccattgccacatccaatgttcctaagattttcttcaatgttttcttctaaaagatttataggttgaactcctaagttgagttccttgaaccattctgagttaattgagttaatttttgaatatggtgtaaggtgatgctatgaattttgtccaacatcattattttgtatgtgggtattaaggtttcctggtactatcagctgaagtggggctgatacacttgtaagatgcagtgagcactgataaatgggaacaccatgcatttatttacttgtctttactccacaggtgattggaggaggcttttggtgacaaacccaaaagaaatgaatacatatgaattcttattaaatcaaaatcaaataaaattataaattttaaaatgttaagagtgaggcaagactagaacatcactagacaggctgaaacatgctgaaatggagggtttactgctttccttgctttaaattttgctggctcacaatggcttatgtttattgcataagggggccacagggagggttgcttgctcacataaggagcccctggttttcttcagaaacaagttcaaattctccacttagagccaaaaaaaattaattgcaagatgttcaaactgaagttggcttctataaagtcaaagaataagcagtaagtgtaaaataaacctcaggaatccaaggaaattctacctttttacctagaaatggcctcacaatgcgtcgctgaagggagagggtcccttccaggaaccccatgatgtaggggtttctgctgcagtcccaaattgagttgtcccttctctctaactgcaggtcccacaagaccttactgcagcttcaataatttcacctggtctaagatttgaggggtttaatgctttttattttgagctgctgtctgggacttagaaaggtgacttgcattttttgtcaaaatattatttctttgatggaatttgacattggtggacactctgccttcctgtgtggttcctacaagggcagatgaccttgcacttctttttggcacttcactagcagtgatagaaggtttgaagttagggcctccctcaatctttaccctctctctaatgcagaggattgcggcctgttggcagaagagtagtgtcttgggccccagctgacctgatgaatatcaacatccaatgccctgtaatgaagtcatgtgtgcacatatcatcacttctgcatgcagtctcatgggaaggtgggttcctggaccccaggttacaggcctaagcactacaggcatacagatggagctccagggaagggagagatgactggggtgggaccacacttttccttcagggtgtccctcagttcaaggaagcttgtactcaagggagagaaagtcctggcaggcctccttacccttggcaatcttggtattggggctggataattatctgttatgtgggtgattgggctgacttgtgcactgcaggatgttcagcatccctggtcattccccacaagatgctggtagcacctcctcctcactccagtcatggcaacaaaacatttttccagacatagctaatgtcctctggtgggaaaattgctcctggatgagaatacttgtttgagaggtagagacactcaggagctgggcctgtagagggaaagtgatccggaagtagatacaaagcagagtggggctggagaagacaggaagggagtctaggtctggaggggcctggcctgatggttgaaggtctggagctcagaacctcagggtatggggaactaaagctcgtgaggaatggggagagtggcagaacctcctattgccagaatatcacactcatacccactaaacacccagcccatggttctgcatctctgggaagtcaggataaatttggctgtatggggtcagaaagagtcctggtaaccctaggctttgtgtgcctcctgatgtgatgaatgtgcggtcacagctcctcctgtaaacattgctgccaaatgtttaacccagagctacataggtccttaggaggcatagcagttagaggaaaaaagttaaaggcatcaggggaaataatatgataaattcagtgtggagaagattccacaggtatttggcctcatctctgaaacaggtaatgccattctaaaagaaaaaagatgggttgattgttatagattgtaggtaattaaagaaacataaccaaaggcaacgagtggacattttaagaaaacaagctataaaaaataggtacaaaaatgtactgaaagaagtggagatatttgaacataaaaggactttaaataatattatggaattatttattttctttggtgtgataatgttggttcttattcttaggaggtgtgtgatgaagtatttagtggtctagtatcatgggtcttgcaacttactttagaatgactcagtcaaaaatcttaatctggacccttttcataagatggtgccaagaacgaagaaggaagctcctgcccctcctaaagccgaagccaaagcgaaggctttgcaaggccaagaaggcagtgttgaaagatgtccacagccacaaaaaaaacaagatccacatgtcacccaccttccggcggcccaagacactgtgactccggaggcagcccaaatatccttggaagagcacccccaggagaaataagcttgaccaccatgttatcatcaagtttccgctgaccactgagtaggctgtgaagaagatagaaaacaacagcctacttgtgttcactgtggatgttaaagccaacaagcaccagatcaaacaggctgtgaagaagtttgtgacattgatgtggccaaagtcaacactctgattcagtctgatggagagaggaaggcatatgttcgactggctcctgactacgatgctttggttgttgccaccaaaattgggatcacctaaactgagtcaagctggctagttccaaatatatgtatatcttttcaccattaaaagaatcttaatctctctattcactctttctcttcacacacacacacacacacacacatttacgtgcatgctataaaaacatatctacctgtatctataaaaagatatatttttattctttatttttaaaatttatgtatgttcgtgaggcacaagtgcaattctgctacattgatatcttgcttctcagtcccacacaaggaagctgtctcacactatagagaaaatattcatgaacaaattcgtatcagtcacagtgagaggtaacactctaaatagcccatttcatgctcaagacatccaagtcaaagaaacccaatagcacagctgagtcccctctgttcccccccaacaccccactcacatcagggcccctgccctggagtgtcacctttattagctgtgagagacaccccagagccctgggcactgtcagtgattggggtagaacaaaaacaggacctggtcagagcccacagatgtggctagaggaactgtggggtgggtgagctccctcataggctcctgaccacaatatcccaacaatctcagggatcagcctccttcatcttacctgcagcctgagagtagctccctctgtttctatctatgggaagaaaatgtcctgtgagaggccagaaaggaggcagggccataaggtcctagagcaaacccctagtctttgatcccagagaagtttccagaaaagtgtaactgtagatccagggcaggatcaagaaatatgaagaaagcagatgtgggtcctggaccaactgccctcctgaggtctgtcatcagcagggaccttcccctgtgatttgtgactgctgggatcaggtcccatcaccaccataatcatcgaagtgaagaatctgtccttcattttcacaggagctttacaaatgagtaggtgctggcacacagggcccaggctgggtagacccatgagtgtggatggtgcttcccagtaatgaggcagggcacacttctacttggggcttgcaacccccagtgggacaagaaaactcagactccactcctcaccccttcctacctgagctcttcttcctccacatcacagcagcgaccacagctccagtgaccacagctccaaggacaacaaggccagcaacgatgcccacgatggggatggtgggctggggagactgctctgggaaaggaagggaaggtgaggggccctgatctccaggcctcagccctgaccctgctgaagagctccagaagggctcctgctttccctgagaaaagacatgacccctcgttcccctctttacccatctccctccttaccccatctcaggatgaggggctggggcagcccctcgtgctgcacatggcatgtgtatctctgttcctctccaggaggcaccaccacagcggcccacttctggaaggttccatcccctgcaggcctggtctccacaagctctgtgtcctgggtctgttcctccccatcccgctgccaggtcagcgtgatctccgcagggtagaagcccagggcccagcacctcagggtggcctcatggtcagagatggggtggtgggcaacgtgtgcctttggaggatctgagaagagtcagaaaattcaggcactttgcactcctcatgggaaaccccagcagcacccatgtgaccaacctgagaatggacaggacacctggggtggggaagggagcacagaacccagacaccagcctggacacagacacctgggaaaatctcctattccttggaaagttagagtctctgaggggggagcagggacttctggccctgacctaagtggaggccgagggactggaatcagagcctcaaacacattgagtgtgaggcagagaacaaaacttgagagaaaagtcacggggcccaaggctgttggagggctcaaaggggaccgcggatcggtattccagggactgtcttccctccattccctcagaaatttcatcccttaattgtcccagagagcagggcggactctcacagtcactctctggtaccggatctcgaaagccaggaagattcttcctactcaggactagagggagggcgatatcctagcattgggtccactttcctcccaaccttgtgcgaggccatcccaagagatctacaggagatagggaaggcgcccatggcccctggtacctgcgcgctgtagcgtctccttcccattctccaagtatctgcggagcaactccaggcactcgccctccaggtaggtcctgaactcctctgcatattcctctgcctcatagaagcgctgggtgatctgagccacggtgtccgccgcggtccaggagcgcaggtcctcgttcagggagatgtaatccttgccgtcgtacgcgtgctggtgatacccgcggaggaggcgtccgtcgggccccatgtcgcagccattcattccctggagggtgtgagaccctagccggtccccgcagtcagccccgcccagctagccccgccccctccccgcccaacccgcggggattttggcctaaactgaaaatgaacctgggtaaaggcgcctgggactctcccgggtggagggtctgggcgggtcccgctgcctcggggtagatttcggatccggagactctgagggacccgggcggtccgtggcggatggggggtggtcgtgacctgcgcccccggccgggttcactcaccagcctcgctctggttgtagcggcggagcaggttcctcagggccactcggtcagtctgtgcgttggccttggcgtaccctgtggtccactcccaatactgcggcccctcttgctccacccacggctcccgcggctccatcctcggaatcgcggcgtcgctgtcgaaccgcaggaattgcgtgtcgtctacgtactccacggcgatgtagcggggctccccgcggccgggccgcgacacagcggtgctgaaatacctcaaggagtgggagcctgggggcgaggaggggctgagacccgccagaccctcctccggaggcggctccctgagtcctgcgcccccaccgggcgggcccctcactcctccccacagaggccgtttctctctggaccccgcactcacccgcccaagtatcggtcagggccagggcccctgagagcagcaggaggaggcttcggggcgccatgaccccaacctccgcgtctgggaaaaatatgagtcccgcggggtgcgtgggactttagaacctgggaactgcggcgacactgattggcttctctagaaacgcgacgcccaatgggagtgagaaatggggccgcgttatgagtatccaggaagaaggacctgacacgggttgggagagaaagagaaactctggggagatggggaattctcaatactgagcctcccaaccccagacaccgcctcggggcctgagcccttgagagccactcctggggccctgggactttgccctccccctccccctccccctcctgtgcagggtgtgtctcaatgtctccctgagtcttcgcccgggggctgagaaaccagggagaaaccttcggcatggacccagtccatctcccttcattattcattccgaaatcccagtcccttgattgaactttctgcctcccattccatacctggactccccggactcttttggaagaaaattcaccccaaggagcttggtgccagacaatgaacttgtcctgagaatgaaggtgtagagacagtttcttcttcttccttttcttcttcttcttcttcttcttcttcttcttcttcttcttcttcttcttcttcttcttcttcttcttcttcttcttcttcttcttcttcttcttcctcttcctcttcctcttcctcttcctctccttctccttctccttctccttctcctccttctttcctcctcctcctgctcctccccgcccccctcctcttcttctctggaaaagttgtacctgagcatatgaaataggacagagaccagtttctttctttcttttttttttttattagctgcagtgagtagtagaatcttggtaacccctgaattatcaggaaccttttttttttttttttttttttttttttttttttttttttttttgagacggagtctctctctgccgcccaggctggagtgcagtggcgcgatctcggctcactgcaagctctgcgtcccgggttcacgccattcttctgcttcagcctcccgagtagctgagactacagatgcccgccaccacgcccggctaatttttttgtagagacgggtttcaccgtgttagccaggatggtctcgatctcctgacctcgtgatcctcccgcctcggcctcccaaagtgctgcgattacaggcatgagccaccgcgcccgaccaatcaggaatcttatgtgtaaaaactgttactttggccccttgatatataaatgtgtctaaatgcattacagttgtacaactctcagagctcctaagttttgctttcccagactatgtatctgtgactcttgttgtattctaaaattaccttcattccatagccctgagtttctgtgggagtccaggacatctcctgacaatacaaagtagcacaacgtgtgattgtatattgcaaccaggagccaatacattcattcacctcaaagttgcaagtgttcaacgcagtcacaatgcccctcaccagtgctcatgcacttcctgtttttaggaagtatccgcatctaagtggtgtgcatgttttattggaacacttagtatttttttaaacctgaaaaaaagcagaaaaagcaattaatttttaggcagtcccacataaggtgttaaaggccaaatgcaaggaacaccctgctaggctctgtagatggatgtattaaaaatttataaaacaatgtgtttaaagctaagaattctgctgctttcaaattctgtccctctgctccttctcctcacctcctgcttctccagcccttccctccgtccctctcatccctcaggccctcctcttcccttagtccccaccactctgtcactcctgaatagtggctctagcactgttccattacctgccacctgagtgttctctccacagtggtcctgctactgtgagtcaaagtgtgtcgtttcttcacctaaaacactccagtggctccacttcggtcttgtgaagcttctagaatgtcaggcacttgagcatatgagggcatacctggttcagcataggcactaaattaatttttgttgtctagttgaatgaaatatgattgtataaaaatttaatcgcatcatggaatattataaaatgaaaaatactggaaaaaggaaatattttattttactcatgtagtgtgcttatcaatttataaattcattccatgtgtctgttgagtctgtgtatgacttttgtatgactgcataacaaattaccacaaacactggctttaaacaacacccatttattgtatttatttatttatttttagagacatggtctccctctgttatccacggtgaagtgcagtggcatgatcatggttccctgcaacctcaaactcctggcctctagaggtccccctgcctcagtgtctggagtacctgggactacaggcaagtaccaccgtgctcaggtaaattaaaaaaaaaaaaaattcctttttgtagagaggaaggtctcctcaaattgcccaggctagtctcactcctggctgcaagtaatcctcctgtgtcattcccacaaaccttaggattacaggcatgagctaccatggttgaccaaacaacacttatttatttatttacagttccttagtcagaaatctgagcatgattggagggttctctgtttagggtttcccaaaactgtgttttcattttgagggcctccttcaggcttatacagaggcgacataattcagtttctgccagttgtaggactaaggttcctgttccttgcctactgtcaaggtagagagaggctgctctcaattcctggtgcccaccagcattctttgccacacagccccttcatttttagaatccacattggaggaaccccctcacactgaatccctctcacactgtgaatctctctgatcaggaagaacccagtcctttcaggggctcgccagatgaggacagcccgaccagggataatccctgtcttaaagtcaattgatttaggaccttaattatatatgcaaaaatcccttcaaggcaggacttacattattgttggttgaataactggggtcaggtgaatgaccaaggttacacgtctatcatgggggggatgatagaatcagcctagcaaggcttgggtctttctttttttttttttttttttttttttttttttattttttattttttattttttatttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgccctcaatccatctaaccctgagtggacacagcacatgtttcagagagcacagggttggggataaggtcacagatcaacaggatcccaaggcagaagaatttttcttagtacagaacaaaatgaaaagtctcccatgtctacttctatccacacagaccccgcaaccatccgatttctcaattttttccccacccttcccgcccttctattccacaaaaccgccattgtcatcatggcccatccccaatgagccgctgggcacacctcccagacggggtcgtggccgggcagaggggctcctcacttcccagtaggggcggcccggcagaagtgcccctcacctcccagatggggcggctggccgggaggggggctgacccccccaccgccctcccggacggggcggctggccaggcagaggggctcctcacttcccagtaggggcggccgggcagaggcgcccctcacctcctggatagggcggctggccgggcgggggactgttccccccacctccctcccggacggggcggctggccgggcagaggggtcctcacttcccagtaggggcggccgggcagaggcgcccctcacctcccggacggggcggctggccaggcagggggctgatccccccacctccctcccggacggggcggctggccgggcggggggctgacccccccacctccctcccggacggggcggctggccgggcagaggggtcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggccgggcagggggctgaccccccctcccccctcccggacggggcggctggccgggcggggggctgaccccccacctccctcccggactgggcggctggccgggcggggggttgacccccccacctccctcctggacggggcgactggccgggcagaggggctcctcacttcccagtaggggcggccgggcagaggagcccctcacctcccggccggggcggctggccgaccccccccccccccgcctccctcccggacggggcggctggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggttgccagacggaggggctcctcacttctcagacggggcggttgccaggcagagggtttcctcacttctcagacggagcggccgggcagagacactcctcacctcccagacagggccgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagatgggatggcggccgggcagagacgctccccactttccacactgggcagccaggcagaggggctcctcatatcccagacgatgggtggccaagcagagacgctcctcacttcccagacggggtggcggccgggcagaggctgcaatctcggctccttgggaggccaaggcaggcggctgggaggtggttgtagcgagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatgagagggagagggagacgggagagggagagggagacgggagagggagagggagacgggagagggagagggagacgggagagggagaggggagagggagagggagacgggagagggagagggagacgggagagggagagggagacgggagagggagagggagacgggagagggagagggagacgggagagggagagggagacgggagagggagagggagacgggagagggaggcttgggtctttcttttgagtttaattgggacacaggtggaaattgaagttcaaataaagcaataattgtgaatgataataaaatacatcctatttagccatggaaattcctcttacctcttaaaaccaaatgacatgtttaatattttataattaatttaggttgggtgtggtggtggctcatgcctgtaatcccagcacttttggagatggagtcaggcagagagcttgatttcatgagttcgagatcagcctaggcagcatggcaaaacccttgtctctaccaaaaatacaaaaattttagccaggcatggtggtgcatgtctgtactcccagctactcagacagctgaggtgggaagatcacatgagcctaggaggtcgaggctgcagtgagctgtcctcctgccacagcactgcagcctgagtgacagagcaagaccctgtctcaataataatgatgataacaataacactaataaatttagagcaaatgaaaattaaagtgcaactattcatcctctcttgtgaagctgtatttttttttactgttacattacaaattactgaaaatgtaacagctcaaagcaacaaatatttatcatctcccacagtttccaatgctcaggaatccaggagaggtttccctgagtgtttctggctcagggcctctcacaaggttgcagtccagttgtcagccagggctgcatcatctgagggctcaactgggctggggatttgcatgaaaaatggctcactcacatggctattggaaaaggcctcagttccttgttgtctggtcccgggaggcctcggtcctagccacatggacctttccacaggtctgcttatgacacagcagctggcttcccccagagttcatgatcccagagacagagagagcaaaggtagaagctacggtaagttttttgttctacaccaacagtcactccatcagatagaagtgaatcattaagtccaggccacactcacagggagggaatgaacctgcacctctgcaaagtggagagtatcaaagaatttgcatatatgttaaaagcaaaattaagcaaaattaaaattattgtttcagaattttataaatccaaagctgctttcatctgattataattctttaatgctttaaacttctctttttaaagtaatgattaaaatttgagacatcacagagccttgggtattgaggggaaaaaagtttgagacagagaaaggagatactatagtatctctaagtttttcttgcaaatacctttaataacaatgttctctttaatgagttgcaacacagctgagaacttacagtaactagatcaaatagttccaagacttcagtgccataacaatagtgccttaaaaataagtatttgttttgcctaagatgtctcaaatttagtttaagaatgtcccaaatgccaattttctcattcaaatatcatctttaaaaatatttgccaaatcagattgcttttaaggtagaaaaaatgtgaatctcatacctcagccaacacatctagcttagcatgatgtcagtaactttggttggatacagtagcccaaaatgcttagctccaacttaggaacaagattttccaaaaactggctactgggtgggcattccataataaacttgacatctttcgctctggtttttaatgagacgtggtagacatgatttggacatcactatgattctaaatagcactgctattctgtacttctacagtattttttaagcaatcctattgtgttttccattcctatttgctattctatcactggttattcctatataattttttcctgtttaatttattttgatcagtaatgtgcatttccaattctgtaaaagtttaattcaggtgtgtgtgtggtagaatgtaacatcgaatcctttgcaagatggaattaccttgcacatcagaccgaacattgtacaccgaaaatctatggagatgtcaatgagccaaggatcaaatgacctatttctggtcaaggccactttcatagcattctggctctctccatcacatggatcattacaattggctttggtccaatgtgaatagttcttggtaagaattattgtaatggcaaaaactgcaattatttttgcatcagcctgtaagagttcaaagtcactgtcttggccgcagaattacaccaggcactttttactcagactctgttaataacttcctgttctttacttgtatcccatacactgtggcattaaacttttaacatacagattcagaaaatgcttccttatatcataaccacatagggttattttatatgttaggaatatttcatgagaagtaggaaaaaatggtgggaaggaaaagaaaaatcaagaagagaataggtggagagaaacgggaaacattatgtatggataatattataaaaatagaaggaaataaatcagatgtagataaccactatggaataatcgaaacataagagaggtttattagctatctgttgctgtgtaacaaactaccccaagacttagtgacttaaaacagtgaacatcaatttactcaaagaaaacaacacaaataccagcaaaactggagcaggtggaagaagttggataataaaaaggattttacaaactggaaaagtaagaggtcactggtgtgtaaatggaaatgattttgttggtccatgttctccaagaagcagatgacatgagattaaagttgcagtattttattagaggactcacctgccagaaaatatgggaaaagatccaggaaaccctgggagagacagcagactgagatgcaagcgtgacccccaagtgagggacaggagaggaggtttgttggacacatcctagaccacaggcaatctaaggagagttgagcaaggccatagaggagtcctctagccacagttggcccttgtcttccagacataggcctcccttagtgtccctcttgtcacccatcactggttgggaacagcccatgggaagcagggtgtctgcaccaatgctgctgaggatgtcagagcacaggagcagggccttgggagattatctgggagcatggttcaaatcttccttcctgaggtttctgggcccttggaaatcaaattccctcaggattggttgctggacaattccactaacacttacaatgggacaaggggaaccaggagacccctcaagtggatcactgggttccacacacattcctcctgccctcattgtgacagcagcccaacctcctcctggagattaggatctattacctgtgcctggagaggaggggactcctcacttgctggtctctgggcacatactgtccaaatctctctgggggcaatagtaatgtgttcttcagtaggctctcatttgtcctgatttaagagtaccttcctttagaatccaggaccttctaccctgcagagcacaggtttgggagatgagaagtgcaaaatcccacagcaggtgaatctaaggaatgagacatggagccatacccactttcactccttagtttctggacccacatgttcttcctactgagaacacggcactgtagagatgtctctgatttaataaatgcaccatgtcccgaaagacagcacccacccctcagagtgcttcctccaggctggcactgagttgtgcctgtagaagacctgtccagcattcttagtggctggcagaccctgggtggtgcagatggtgatagaaccagtggatcccatggccatgaaaatgctgcacctgcttccctgtcaagtgggttccaccaggaagacagtgtgctaagagcaatgccatgcctgtgaatcaggaatgtcaacagtccctggagagtggtgctgactgagggtctgagagcaggacaggaaaacccactcatggaatggtgcctaaccctgtaaagatgaacctctggcccttccagaatggaagtggctcaactaatcacttagcagcgagtgttgctttagtcacctaaagaaatatagccccactgaggcacatcattggcctcaaatgctaatgagttggacattcagaggtggcagcagctggatctgtcttggtaggtggtagtcagtgcttctggacccatatttagcctcattcctgccactgtgcttgctccattcatgaactcatcctgccaggcctgggctgcccgatggtgagggctggctaacttcaatttgtctgcttggttgtttagtgccacttcaggtttggatgttttctggaggtgtcaacataggattcatgctcaatccagatggaccatttctatctcatgatggatgctttggggtctgtccgatctatgactttctgagttacagaagccaattcatatgggcatttgaaatcacatggttgtttgatgtcccatggcaaggattctatcttatcaaggccagtaacataccaaaagttgcttctaacaggggcatatgtctctgctgtggatgacatggccttactccagaatcccaggccctccgtgtgactcccccactggtgcttgtttcagctccatcctgcatctttccccacgactgacacctctaggtgggtctgagggatggcgctgcctcatggcctgaatctgccagtgtcctttcctcagcaggcctaattgaagcaagtcccctcctatttctcctagagtgtaggtcaaagcaatagatgtgggatgtggtgttgtcagaattcaaagaggctcaccaggcagtgtgcttccttccttgtagtgaggatgcaagatgcaacactttgtcttttactgtggaggagaaactcctggatgtcctcaaccactggatgaataaaacttcaccacagtggccactcctgaatctctgtgtggtttatcttccatctgctggagagcacgtgttttgccaaggccttcagcatacttcccatctcctactcatccatcctagtcaacatgatgttgttgatgaaataagctgatttaccattctataggatgccaggttcttcagatctcttaagactatactatagagggcaggtcagttacaataaccctgaggccaattatcaataaatgtgttgtggatcccacatgaatcacttcatgtatagtttttctcattggaatggaaaggaatgcactcaccaaatccacagctgcacactttgtgcctgaggccttatcaatctgctctaccagtgatatccagccagcatggcagctgcaattatgactcctactttttcaagtctgaagtaatctcattcattctttaggccccatcaggcttccttggggacagattgctggattacgtgaagataacaggcaactccaacagcacccctcatccttcagctctctaatggtggtgctacacctaaaatacctacagtacctttcataagactcaccctgggactcaatatcattttttatttggccaggatgaagtcagttgcagaggtttccctttggctttcagacaatgacagcccttattccagagacttgggacccaatgtgggggttactccagctgccagggcatcaatgccaattacacacttggagaatggggagataaacagggctgggtctgtggacccagtagtccctttgtgatgtgtccagatttattcccagcttctgtaagccccactgtggtagggacataatggtgctgtaggcctgtaggcatcaatatcagctcacacccaatgtcaacactcccccaaattctgcctgtttccctttcctagtgtacagtcccctgagtaaatgactgtaggctcctttgcagaaagacagagggaattgttccagcatatacttgccatgaggtttcagggtccttcctcctggaatagggactccttctctgtaactgggatctgaatctgaaacttggttgacgtttaggaattgagaatgggatcatgactttgtattgagttaaacaccctcagccccctgctcatcaattcttgctttctcatcacagatgtcaagcagtgcccttgttggctgctgcctgttctgacaccaccgtctattaaccttccccacaactccctgcagatcaagctgcctcagctgctcctctgagattgtcaagttaaccgtgccctctggcttttgcaggccactgtcaccatttagttctctgccttttcaaggccacactttcctcaggaatatcaatgagcccaactataggacctccttcctgccatcacacccagcctgcagaggacaccaccccgacgcttcttagccatgcaagtccctctcaccggcacattcctgaggctctggtggaagttgtgccctatgggtcctctgtggagcatggccctagtgggcattctggttcacatgatgtctccatcccacacacccacttccctcagcctcattgtccatcctctacatgttccaggacaactaagtcatgtctaacttactgagagttggacatcattttttccagtctacatgggtccaccccagcagtgggtttgccccatgccctgaggtccttgataaacccataccctgagaaagtgctcccaagccaaaggtgtttttttttaatttatccagcttgattctggccctttgatcaaacacccttaaattccaatcccagaactgctcctcaggctcctacggggacataacggctgttactgcaaagctcctgagtggaattcccactgcatcataggggtgaggtttctgcagcatcttccagtgtaggaagtgggaaccattactagagaagggcgagcctcctctgcatgcccagagagttctaaagggcacccataggataaccctgttccagtttgcagaatcttaggtttccgcaccaaggccttgactttcccacagcaggtctgcctctgatgagtgtccaaacatctctgtagtactgtgacttttaaaatgatgtcatcagctatcattccactctgcaaggggagaggggcagatgcccctcctcggtctgtctccaccaggccctgtgagggtgggtggaggctctctccaagccctcgtttggccccaccccagcatgtctccaggttcctctcagccctggttccttttggccctgcagtcacaatgggcaacactgtgacgcaccctgtcctgtgtcacagtgtcatacactcaggctcacattgcccctaggccacttgccagccaagggacatggccacattttgtgtcttctgcacctcagccttgctttcaagtgcaggtgatgatggcacccacgcagaacaaatgttatttgctatcttcgtcgagtttagtcatccaattttccaaccctcactgggcaaggaagagtgtggtttccaccagaaggcaggatgtcagcagtcacaggggcaaccaacagggaaagccactggaaaatagaccccacaggaagcacaggtgtccagtggagatgggaaccctgcagatttgaccgtctttaagcagattagagagattaccattactaacaacttagccataaaagtttattagctattttcaaaaagcataaaattatgtaatataatttttttttaatttccatcaatacaaaactaatctgggcactgcaacttctggtgggcaactgggataggcggcatcatcaggaaggcgagccctgccgtgccccatgtgccagtgccccagatggcggcagcctccccagaagcaccttgtatctcccctgcacagggccagggtcccagcttcccatacaccttctcctgctttttcttttctgtcctttcctttttcaataaaccacctgcaaaaaggaaaaaccattctgaggacaagaaacatgtcaatgggaaatacacagttgccagagggtaaaaggccctgttcattctcattgaaaagctcaggtatttctgttaaagtctctccttttactttaggatgctgactcctgcgtccatctcaacctgggcatcgtgccaccaccttcaagaagagaaaaactaagtagtgctttgcaaaggggcagcagcatttctcatttctgaccatgtcaggcacacggccatgcagatgagcaggtgggggacacaggtgagtctccagacctgctctcctcccacagtacattcttgagtctttttaaacagttgtgaaaatgccacagatgcaagcacctgtgggccactcccatggggaccgttgcacaaggcagtgccactcattctcagaacctcctaccatgggctatgcttagtgacccgaggccaagccaaggaagacgccagccacagggtgccatcctcaggggcatgctgccagcaggggcaaagttatccctagcaacaagatacagaaagaaagaaaaaaggaaggaaatgtagccaatgggccggttcaggttcttgactttgccacacaaaagaatttgagagcaagtccaaagtaaaagtcagcaagagaatttattgcaaagtgaaagtacactctgacagctgatcagagcagctgctcaaaagagagacagtaccctcccctcacgggagtcttacatgattattcatgaataggtgggaaggggtattgttttaagcatgttctgtggtctcttgaacgtgcatgcactgtggttgtacatatcagcacacacatcttacgtctcattagcatcttaacttccctctcagagttgtgtttgctactattgtaatgagcataggtcagcccaaggacgctattcatgggtttctgggcttcctcagatgtggggatgcctcccttggctcttctacctctttgctgcaggatgttctaaccacaagcccaggatatggtttgcgcactgtcgaacagcttgttctctccatcaacctgacaagtctcttgtttcctttcaagtgaggctgtgaacaccctatctcactgacctcagaaggacagtacagcagtagccaccatgaccaaaaagatgattccagaagtgcaggacaactccctacccagaggctgtggctgtgcagtaacacaccaagaggggagtccagctggctctcagggtgctcactaccctcatctgggggcctggaggacgtcaattcctgagaacgccacgttctagtgagtagaatgaactaagagatacacagcaaagctccacatacttttccttttctttgtgcccgcagtgttcttcatcagtgtgctctcgcttttcagctactactgttggctggctggaaaaaatagaacaatagtaaaaattagagaccagtctttggtgatgaagagaaatattggctacttccagtattttctagctttggttatggttgcagttttccagctcaccttgtggggatgaattcagaaaaaagttacaaattgaaatgaacatgccagaagtattggctcaaatcaacgttgtcctattaagccacttagtgaatcaaaagaccgcttgttggactgttaatctcggtggccagagaaaggagctgaagaaggtgttgccagatcaggaacaaataattacagcggcaatagaaaatggaagaccacttgttcataaccatttgaataagggcaaggtgtatggaaacacattatgaactgatattttcagttttgtttgcaagaaaatgattaataaggtgaaataattgaagtatcacggaagatacattaaaaaaaaaaaaaagcctttgtacagtttgctggagccacagatgtcctactccagagcagaacaatgcctgaatcttcagggtccatttgtgccgcattcactagcaaccacaaatgtgacttaattttactttggaaataatgcttacctattgtgagatgctgtaatatgaaccatcattacatgttaacatggcacatggaattttgagtgtctaagttacatttttagagttgtttcttagtagccatgtgagtttccactccaaaaacacaagctaaaaacttgttttgagtgaaggacatctagggcaaatggtggctgaaagtgaatgagatcccaattactctttcttgtactgtataaggaaaagaaaataagtgcttttcttgttgggtgtttgctaatttataattaccgttttatgcttttcaacatttttaataaagttttttattgttggctataaacgttttaaaaggattctcttcctctagaatcactctaagtaccaaaatctgtattattctggattcaacagagaaacagaaccaataaggggtgtgtgtgtgtgtgtgtgtgtgtgtgtgtgtgtgtatgtgtgtgttttattcgtgttatgaaactgactcatgcaattattacggtggcaagtgtgaaatctgtaggatacgccagcaggctgaaaatgcagacagaagttgatatggtagtcttaagacagaatttcttcttttctgggaaactgtagtttctgctcttaaagccttctactgattggatgaggtccatctacattattgagggtaatttccttttcataaagtcaactgattgtaaatgttaaccacatgtactaaatatcttcacagcaacatctagattaggttttgattaaatgactgggtactatgtcctagccaagtttattggcattgactctgggtcaaggcaccgtgtctccctcccatcgagttttccatcatctacacgagacctagatgactactttgatatctactgcaggccacagccttgtcaaagccagccccagctgaaatgcactcacctgcattcccacacaattttacatacaattcgggggaggttatgggatctatgaagaccaagggtctgtggtcctgtgacactttctctcagagggtgaagaaggagttccttggggcagcaactccccaggggtctcctgcctgcctctcctcccctctcagccccaatcctctttcctgctgttgatcatcatgcagtttttaaatccctactccctgccccaccaaggttgggctctaggacctgcctattgggaacctgcggttgggagaaagtatgaagtgacccacctgaatttagaggagggaagtgaggaatttggagacatctaaaaacattttgtccctgtggtttgacttcaaattattatctatttttattggagatttgtttgaaattataaccggtatctcatgattattcagcatatgccatgccccctggtaaccctggttcttatttttttaaacttgtacaaatattttaagcaaacacagaagtagacagaagagtaaagtgaccttcactgtacccttcactcagtaacacccactcttgatttatctacatcctcaaccatagcccaacaccaggttattttcaactaaatcctagacaatatattatttcacatgttagcaattttcttttgaaggtgccaatgttcagcttctttaaaaagagaaacagagacgggcaggagaaggattgaactgacaaaatatattttcaaatgcaattaaggcagaggacaatgcaggaacccttgagtcccgttttaactgaatgctcagcacctcttagattctcaataaaagaaagcagcagcccagagccaaggagcccagggaggcacatcatggtttgattttgtgactgttttcagggcagtatctgtcatctctgaatggttacactggacatttctattcccacccttgcaatgggactccccagctcagagaaagggaaattatcacccattctcatttatacctttaatgccttcatccattcccttggtcctgactttccggttggaggagggggaggaaaagcagaggcacgaaattgaaatgtcttctctgccatctgctggggatatgcttgaataacaggaaaggcctacataaaagatatgcagcgaggaatagaggttccttttcctgtttccttcaggaaatttcccctagggcagacagagcaagagcgatggacagaggaatgggagcaggacccagggggaggtctggtcatatgtgtgcctttctgcctccccgtctgtcattgtccttcctcaccaggcctgcagaccacctgcgatgacctggcctcttgccatccctagctgggccaaaattccatcacagggacacacaggatggcagaagcgcaaggcctcatacccgctggggcagcctcctggagatggcctcagaagggcttctgggagcttctttaaaacctgcactacaggcaccaatttccccagttatcccatccttaagtgaaaaatcaaccacagagatgatttattgtaatagccttatttcagtacaagcagacgaaaagtgtttctcttcactggcccgttagttacaatggggaggggtcactgagtgagcagcgggtggtggcagtgacgaccacaccctctcactgcggcccaacacttttgagacaagttcccacctctccattagacgtgtcttctccacatgcagaaaatgtggtctcgtagcttcccttctcagtgctggattgctggcatttcttttctttatcagagacatgaatatcttttttctttatggatttctaagacttcagggtttttcagggagaagttgcttaaggaggctcctgcgtggaccgagtccttcctgagggtttgctggatgcccccggacactgtgcagctgtgtcctccggggtccctaaagctggcacgttctgctgtgtacccagaggtggggacagatgctgccagctccaccttacagctgctacatgaaatttgaggtcagagaattctcttgtctttaagggcacccacatttgccttcttcgatgtttcaggaaatcataactgaatttagaaaggttcccttttcagtttactctctggaaggaaatatactgaaaattcagtttattttcaggtattgaatagaattgaaaagtcaaactgtcagtttgcttgcagtgcacacagagaaattgagtgttccaagccattgggacatttctagaaatccatccttttccagtaggacatgagtaaagtcagtgaggagcgaacctgcagtccacgggcacctccaggattgtgggaggagacgcacatgtctttctgatgtgtggagtcctgaggacagaggctgagaccctgcatttcccaaagtacttgttttctaagcaagtgtttctgctacttgaaataaacttgggggtgtggaagccaccttgcaaccaaccaaacacaggtgagaaaatgaatatgaagtgttctgggagaaagcagaaaaccccattgccatcatgtttccttatttttacaattctcttaaacaacgtgcctaaggttataacccctcccgtttgtaacaacttctaaattgaaagggcattagtaagtgtggatacagaataaatgctgaaaatcagtgctttattcaaagtagcgatagagtctcccaggtgtcaatagagaggtgggccagggacttttcccagtgaccagaaacaagagcctcagggagatgaggatgtctcacagccagggacgggacagtgaagggcatcccaggacgggagtgcatcccaggggtctgttcctgtttagactccaatgctcagcacccagtgcggcacgtggcaagacctcagcaaatatgtcagttggctggatgaaggagggcaggtgtgagccaaaaaaagatttttgctggggcataaatgtaaaagtgttgatgaacctaccttgcaaggagatagaaaggtggatgggtggatgggtggatgggtagatggatggatggatggatggatagatggatggatggatggatggatattcattttctctatgtgtgtgtgtacgtgtgtatctatctctgtctgtctctctgctctttctctccatttgccattgttccttcacaatcatgatttcactaactttttttttttttctttgagacagagtctcactctgtcgcccaggctggagtgcaatgtcacaatctctgctcactgtagcctccacctcccgggttcaagcgattatcctgcctcagcctcctgagtagctgggattataggcacatgccaccacgcccggctaaattttgtatttttattttgattttttttgtagagatggggtttcaccatgttggccaggctggtctcaaactcctgaccttgtgattcgcccacctcagccttccaaagtgcatcagtaacatcttttacctggtcttacaggaccttgcctgtctattctattcgtggtcacaagacagaaaaagaaaaggagtgtgtggaaaacaagataaggaaacatgcttctgatctggggcagtggggagacaggggctgcgcctcactgcagagtccatcctgctgaacacagaggggcaaaagcgcccagacagccatacctgtgctgatcagaagggagggctgcgcctcgcgatccttctacctgtgtctttcaggctttgctgtctaggtccaagttactgctatgaaaagagatttgagaattcccagaggggcctttcagcctctttccatggctcttcctgccctttcgaaagcacagccagagacatcagaaatgaaattgtacataattcttttggactttgatgcaatctttggaaagaatttttgtaaatgccaagctacattttggcaaccccatcaagagtcaggtgtgcccagggcagtcaacccaggccctggactctcattctagttggattctatgacagctattttgccataagaattctagagccagatcttgctacaccacaattgcctcacgttgcaagacaaacaaatctaacctgagtcctgtggattccagaggtgctcaggaggaacctccgtctcagcgtggttgacctcaggttcagccccgtctgcccattcagcccgcagccccgtcccggagagcactcagaatccgagagcagcgcagcggcgcccccgtgtggccacagggccgaggacagagaccccgctcccctttctccctagccaggacctcccaggctctcctgttcccagcacctggacagggctctgcatacaagggggttcccgatctcaagtcaggctctgagtccatccagcttcccaaaatccatgttgacactgacgtttcctcccaccactgagtgactctggattttggctttagggaagagatacctccaggccaaaacagtgggatcatatctggggctcatccacccccaaaccattgctaccacatgacctagtccctcagcctccaaaatggggccttgccctcctgtcccctcccttgttcctgctgctgctcctgcaggtggaggctgctcatcccaggaatcagcctgtgagctccaagcctggagtccgggcctggggccttggtccagagagcagaagggagatgaaatggatcataagagaagggggagagtggaaggaaccaggggggagagaaaaacgagaagggccctgttagaagttgtgtgtgcatgtgtgtgtgtgtgtgtagatcaggagggggtttctagggacctggggaaaggagagctaagggcaggtgctaaggggcccagccctgttaattccaaggtccggaattaattccaggatactgcacttcctacagtaccactttatggccatatccaagtccagccctgagcagcctatggtcacagaaaatcgtgagaataatcagagaaaaatgacacgttacatacatgagaacaattatgagaatgaccagtccatgtgttcataatttgtcatcagaaactatggtggtcagaagacaatgaaatggcatttttttgagtgctgtaagaaaacaacctaactcagaattgcacatccagtaaaaatattttcagggaagaaaaatgaaaaggtgtctccagataaaataaaactaggataatttgttgcaaacataactctactgcaagaaaaatactgaaggagtttcccaggttgaaagaagtcataccagatggtaacttgagtcttcagataggagtgaccaacactggaaatgccaaatatatggtgggaagttaaagatgctctattttttcttagttttttttttattaatttttttttgagatggagtttcgttcttgttgcccaggctggagtgcaatggcacaatctccgctcactgcaacctctgcctcctgggttcaagcgattatcctgcctcagcctcccgagtagctgggattacaggcatgcaccaccacgcccagctaattttgtatttttagtagagacgtggtttctccacgttggttaggctggtctcgaactcccgacctgaggtgatccacacgtcttggcctcccaaagtgctgggattacaggcgtgagccaccgcgcccagctttttcttagttttttaaaaatacaaatgaacaacactatcaaccgtcttgatctgacatttacagtcactgtgttcaacagctccagaatatatattttgtaaagtgaatatggtacattcactaacacaggtcatatgttgagacataaaacaagtaacaacatatttcaaaggactgaaatcatacagaatatgtactctgaccaaaatagattttattggaaatcaataataagttgtctaggggcaaaaaagtattgaaaattttaaatcttccttctaaataacctacggatcaaagaagaaaacataagggaagttagataatattttcaactgaatgatgatgaaaacatacctttcaaaattattagatactatttccagtctttctgcaaaggacagtgatcaagagagtgtggtattggcaaaaggacagacacatagatcaacagaacagaatggagaggccagaaatggaaggacaaaaatagagtcacttgattttgaatacaagtacaaaggtcatccaatgaagaagggaatctcctttcaataatgatgctgaaacaattggcatccatctactttgggaggctggggcaggtggatcacttgaggtcaggagtttgagactggcttggccaacatggtgaaaccctgcctctactaaagttacaaaaattagctggtgtggtggctcatgcctgtaatcccagctactcgggaggctgaggtagaagaatcacttgaacctgggaggcagaggttgcagtgagcagagatcacgccattgcactccagcctgggccacagggtaagactcaatcacaaaaaaaaaaaaaaaaaaaaaaaaaaaaacttgacaatacttcacacctataaaaaagtaactcaaaatgtatcatagacttaaaaataatatgcacagccataaaacttctggaagaatataaaggagaaaatcttaaccttgagtttgagtttttagataaaacaccaaaaatacaatccatgaaagagaaaacaaatcaattagactttatcataattaatagtttttgctttacaaaaacactggtaagtgaatgaaaagaagacaaggcacagactggaagaaaatacttgtcaaaaaactggaagttatagatgtgacaaaggacttgtaaagataatatgtgaacaaaattaaaacacaataattggggaaaaaaatcttgattttagaagtgggtgaaagatctcaacagacaccaccaaagaagatatatgggtggtaaataatacttgaaaatatgcttaagatcatctgtcattagggaaatgccaacagggtgcagtggctcatgccttcaatgccaacactttggtaggctaaggcagaaggatcacttgagcccaggagctcaagaccagcctgggtaacatggcgagacaatgtctcaacaaacaaacaaacaaacaaacaaacattaaccaggtgtggtggcatgcgccagtgattccagccacttgggagagtgagacgggaggattgcttgaacctgggaggtggaggctgaagtgagctgtgatcgcaccactttactccagcctgggcaacagagtgagactctgtctcaaaaaacaaaacaaaacagaacaccaaaacaaagtactgctacactattagagtagctaaaattttttaaacttacaataaaaaatgctgaaaatatacagagcaacaagaattcccactcactgctaatgggaatggaaaacggtaaagccactttgaaagacagtttagaagtttcttataaagttaaggagagacttaccatcaatcatgctcttaggtatttacccaagttaattcaaggttgatatccacacaaaaacctgtacatgaatatttatagcagctttacatatgttcactaaaaactgtaaacaaccaagatatctttcagccatgcaagactaagcaaactgtggtataaccatatggatcataagaaatgagctattgtcaggccagatgaggtggcttacacctgtaatcccagcactttgggaggctgaggcaggtggatcacctgaggtcaggagtttgagaccagcctgggcaacatggcaaaactccgtctctagtaaaaatacaaaaagaaaaaattagctaggcgtggtggcgagcaactgtagtcccagctcctcgggaggctgaggcaggagaatcacttgaacctgggaggcagaggttggagtgagccaagactgcatcattgcactctagtctgggcaacagagcaaggatctgtctaaaaaaaaaaaaaaagctgttgccctggtgcagtggctcattttgggaggccaaggtggaaggatcgattgtggccagggttcaagaccagtctgggcaacataccgagatgctgtctatgtttatttaaaaaaaaaaacaaattggccaggcgcagtggctcacacctgtaatcccagcactctgggaggccgaggcatgtggatcacctgaggtcaggagttcgagacaagcctggccaacatgaagaaaccccgtctctactaaaaatacaaaattagccgggagtggtggcgcatgcctgtaatcccagctactcaggaagctgaagcagaagaatcatttgaacctgggaggcagaggttgcagcgagctaatatcgcgccattgcactccagcctgggcaacaagggcaaaactctgtctcaaaaaaaaaaaaaaaaatatatatatatatatatatgtaaataagctattaatccatacatcaattaatcttaaatgcgttttaccaggtgaaaaaaatgtcagacacaaaaggcttcattttatctgactcaattcatataccattctggaaaaagcagatctatggggacagaaaacaggttaatggttatcaaaggttggagggagaagggataaagaacattcaaagggaaatttttaggatgaaggaactgttgtagatggtactagggtagtggatatatgattctatacatttttcaaaatccaggctgggtgtggttgctcatgcctgtaatcccagcactttgggaggccgaggcgggtggatcacctgaggtcaggggttcaagaccagcctggccaacatggtgaaaccccgcctctaccaaaaatacaaaaattagccgggactgttgatggacgcctgtaatcccagctactcgggaggttgaggcaggagatggaggttgcagtgagcccagatagcaccattgcactccagcctgggccacaagagtgagacttcatctcaaaaaaaaaaaaaaaaaaaagtcattgttgtaaaaagggcacaggctttgctacagatttttctaccagtgaaaagatgtatacacttgcctggcctcatcattcagaccaattcataaaataacaaatgcatggaaaaaaaaacttaaaaacacaatcatcatgtgactgacttccaaattagattctccttcaaatcagagagtattgcttgttaatagtgtttataaattttaattcctgattgctgagacaatatgtacataaaatatttagccaaagagttcaaaatgaaattacccaaattacctatttgttattttatacatagtaattattttttaaaaatcatttggctgggtgcggtggttcatgcctgtaatcccagcattttgggaggccaaggcgggcggatcatgaggtcgggagttcgagaccagcctgaccaacatggtgaaacactgtttctactaaaacaacaaaaattagccgagcatggtgttgcgcgcctgtaatcccacctacttgggaggctgaggcaggagaatcgcttgaacccaggaggcagaggttgcggtgagccgagatcacaccattgcactccagcctgggcaacaagagcaaaactccatctcaaaaaaatttttttaaaaagcataaattaaaaaataaaataaaacttttaagatgttaagcccctgaagctccaactacaaagtagggtaaaaggctgcctaaagcagtgaagatcaaggagtgaccttggaggcagcagagggagactgtattagtccatttgcgttgttgtaaaggaatacctgggtttaagtaatttataaagaaaagagatttatttggctcacagttctgcaggctgtacaatcatggggccagctccactaggattctggtgaagtctcaggaagcttttacttgtggcagaaggcaaaggaagagcaggtgtgtcacatggagagagaaagagcaagagagctgctaggctcttttaaataatcagctctcgtgtgaacgaatagagtgaaagctcactcattaccatgggcagggtactaagccactcaagagagaaccggtcccatgacccaaacgcctcccactaggccccagctccaacactggggatctttcaacatgagatttggaggggacaaacacccaaaccttatcagagatgatcccagccacaggtctcagagaaccagcagagggcactcctccagggcccagcctgagtgtggaaatagctgtcagaatcacatcagaatgtttcagaactcatggggaaaagctgagacagaaaaaaagaagaaagtaagaagctggcagaaatcagctaggaaccttgagagacttggtatttcattgaaaggtaagataggagtgttttgactcccgtcgtccctaaggaagaccaccagtatctgaactgtcggagagctcctctgccctcacaaagccaaacactgatgtgcatggcgatttgggaacttctggagggcatcacaccagacaaccaacttgcgctgggtcacttgtccctcctccagactcgggcagtgttggcagggtgccatattaggagtgtagccatcaggggactgtgtccttcccagggaaccccaacctttgtatattcacatcacagaagctcctgcagccatgcccccagtgcccacttggattgtggcagccacacagggctggctggacccagtggagctgcagggttcccagtggtctagccatcagggattgctgctcctaaggaaagggagactgcagtacacaaaaaaagtaccagttgggacaaaggaggccagaccatgtactcatctgtgtccaagagctccttgtttgtgggctgagtgactgcaccacttccagcagagtcgtggacactgtgttcagctctgcgctgaaggagtgtagttccatcccagcagccaagcagccccagtgcttagaatcaggcatggaaaggggaaattctcctgcccttcccccatccaccactgcttcaaacacagcatggccactcccatgggaaattggcacgtgtgccagagaagagcctttctagggctatcaggggtgactgtgtttccactggcagtgtggccatttgggccaggcttgtgtgaaagacagggccctttcccctctctacagggagtgctagcattcctgcagtggagagcaggaaagctgaaaagctatgtgcaggccaggcgcggtggctcacgcctgtaatcccagcactttgggaggccgaggtgggcggatcatctgaggtcaggagttcgagaccagcctgaccaacatggagaaaccctgtctctactaaaactacaaaaacaattagccaggcgtggtggcgcatgcctgtaatcccaggtactcgagaggctgaggcaggagaattgcttgaacctgggaggtggaggttgcggtgagctgagatcacgccattgcactccagcctgggcaacaagagcaaaactccatctcaaaaaaaaaaagaaaaagaaaagctatgtgtttggggttgagggaggatgctctgcaccaaagacatttaaatggtgagctgaggagaagacatctttaatgagtctcaactacattgcagttggagatagagagtagtgtctggtcaatttgagtttccccgatgccaggactagggaatgacagggaaatggatggcattcctgcctggccaggtcatgaagctggggcagccctctcctcatctgtggagacctaggcacgtttcaccagaagtttcccatgccatcactcctgcctgaaagctgctgcctgtgctcaccattgtggggcaggcttggggatccagctctactcagctatgtccccctctctggtgctgagcagggagcccaggctgctgtacattccacttaccagcacatttcctgaggcaacagagaacttttctaggtatacaatgatgaagcatatactcacgtgcttctgccacataggcttttaggcataagcccacctactgttctggaggctgaaccacgcacctcaatacaaatcagttgacaaaagggcacatgagtggaaataaacttctcatctcttccaaaagaggaaatgagataaacttcttaaacctctgccatcctggccctgcaggaggctgtgagcctgttcacactcccagtacatcaccaccacaactggcatttgagaaagccaccatacaaaggctatctataaccaggggacaactacagcgtctttgccactgaaagcattcacaaccaaatgcaaaggaccttaaacaacatacattatagtcacatagtaaagggaaaaaaaaatcctgcccaaatgaaataaattcaaaaataagaagagaaagtttctacagatgagaaggaaccaaagaaatgattctggaactctctatgttttctattttttaagtaagtcctttgtttctctgttgaaaacagtagaatgttttgaaaacatactctgaaaaaagagtgttatgacatccccaaaacattacactaactttctagcaatagatcctaacaaaaataaaatctttgaaataccaaataaataattcaaaataatgattataaagaagctcaatgaaatccaagagaaagttgaaaacaacacaaagaaatgtaaaaaatcaattcagcatatgaataaaaaatttaccaagagataaatatttttaaaaaagtaaaccacctgggctgggcgcggtggctcatgcctgtaatcccagcattttgggaggctgaggcgggcagatcacgaggtcaggagatctagaccatcctggctaacacagtgaaacctcgtctctactcaaaatacaaaaaattagccgggcctggttgcaggcgcctgtagtcccagctactcaggaggctgaggcaggagaatggtctgaacccgggaggcagagcttgcagtgagccgagattgcgccactgcactccagcctgggcgacagagcgagactccttctcaaaagaaaaaaaaaaaaaaaattaaaccacctggaaataaaaaattcatcaaagtagttccaaatgcagctgaaagctttaacaatagactagaccaagcagaagaaagaatttcagagcttgaagacaggtctttcaaattaacccagtcagacaaaaagaaagaaaagagaattaaaatatgaacaaagccttcaggaagtatggggttatgtaaaacatctgtacccatgaatcataggtattcctaagggagaatgaagggtaaaaagtgtggaaaatctacttgaggaaataattgaggaaaacttccctaaccctggctacagatttaaaatccagatagaagatacttagagaactcctggaaaatacattgcaagatggacttcaccaagacaaatagtcatcagacaatctaaactcaatgtaaaggaaaaaaaatcttaaaatgagcaagagaagagaaaaagtgtcctaaaaacctatataggaaattccatcagtctaacagtggatttttcaggccgggcacggtgggtcacgcctgtaatcccagtactttgggaggctaaggtgggtggatcacgaggtcaggagatcgatactgtcctgggtaacacagtgaaaccccgtctctactaaaaatacaaaaaattagccgggcgtggttgcaggcgcctgtagtcccagctactcccgaagctgaggcaggaaggagaatggcgagaacccgggaggtggagcttgcagtgagccgagatcgcgccactgcacgccagcctggacaacggagcgagactccgtctcaaaaaaaaaaaaaaaaaaaaaaaagcactgtgaaaatccctatcctgtttgttccgatctaattactgggacatgcagcccctagtcacataacccctgcttgctcaatcgatcacggccctctcaagcgcacccccttagagttgtgatcccttaaaagggacagaaattgctcactgggggagctcggctcctgacacaggagtcttgccgatgcccccggccgaataaacccattccttctttaactcggtgtctgaggagttttgtctgcggctcgtcctgctacaatatggcgccattgcactctagcctgggcaacaagagccagactccttctcaaaaaaaaaaaaaaaaaaaaaaaaaaaaaaaaaaaaaaaaaaattgcggccgggcgcggtgactcacacctgtaatcctagctctttgggaggctgaggtgggcggatcacgagatcaggagttagagaccagcctggccagtatggagaaactccacctctattaaaaatacaaaaattagctgggcatggtggcacgcacctgtagtcccagctgctcaggaggctgaggcaggagaatcgcttcaacctgggaggcggagcttgcagtgagccgagatcgtgccactgcactccagcctggctgacagagcgagattctgtctcaaaaaaaaaaaaagaaaagaaaagaaaaaaagaaaaacaagcaaagagtggtgatgaaatttgaaagaagggactaggccgggcgaggtggctcacgactaatcccagcgctttgggaggctgagacaggcagatcacctgagatcaggaattcaagaccagcctggccaacgtggtgaaaacctgcctctattaaaaatacaaaattagccgggtatggtggtgcgtgcctataaatcccagctacttgggaggctgaggcaggagaatcgcttgaacccaggaggcagaggttgcagtgagcccagatcgcgccattgcactccagcctgggcgacaagagtgaaattccctctcaaaaaaaacaaaaaagtaaaggaaaagaaaagaaaagaaatagcatatagtagcatataaattcccaaacattaaacaattgcctttgttcatataaacaataaaaagttaaaatttttgtgaggcgataacctcatatataatagaaacaaaaaggtttttaatgaaaaaattactaagaagtgtgcaaactttaaatgaaaacattaaaacacatctgaaatttaaaaattagatatgaacaaatcgggccgggtgcggtgtctcacgcctgtaatctcagcactttggcaggctgaggttggaggatcacctgagatc

SEQ ID NO: 50 - DNA, 1035 bp, Homo sapiens
gaattccggcccgccgtcccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatccccggaattc

SEQ ID NO: 51 - DNA, 3248 bp, Homo sapiens
ctagaacgaaaggagtgaggcgccgagagcccagataccattttggcgtgagagctggtggttggcaaggccgcgggagtgggaagcgtccgccatgttctgcgaaaaagccatggaactgatccgcgagctgcatcgcgcgcccgaagggcaactgcctgccttcaacgaggatggactcagacaagttctggaggagatgaaagctttgtatgaacaaaaccagtctgatgtgaatgaagcaaagtcaggtggacgaagtgatttgataccaactatcaaatttcgacactgttctctgttaagaaatcgacgctgcactgtagcatacctgtatgaccgcttgcttcggatcagagcactcagatgggaatatggtagcgtcttgccaaatgcattacgatttcacatggctgctgaagaaatggagtggtttaataattataaaagatctcttgctacttatatgaggtcactgggaggagatgaaggtttggacattacacaggatatgaaaccaccaaaaagcctatatattgaagtccggtgtctaaaagactatggagaatttgaagttgatgatggcacttcagtcctattaaaaaaaaatagccagcactttttacctcgatggaaatgtgagcagctgatcagacaaggagtcctggagcacatcctgtcatgaccatgcgccgaggcacttccaggcttcactcaactcatggactcctctgtactcactctctccaccctcccttcacctccctctttgattttagaagctatagacattgtttaagataactaagaatacttggctaagaagtataatttgctaactattaaggactttctttttttaatgttgtacactattcttcctactcttttttggttttggttttgttttgtagagactgtctcactatgttgcccaagctggtctcaaactcctggcctcaagcagtcctcccaccttagcttctcaaagtgttgagatcacaggcgtgagccactgcacccgacccctactcctttttctaataagctgtatctgtaatcacagcattcctacagttgttacagtgtgttttttaaatgaaagtaaacatggttacatttgaatctcttaaataatcagtcacttggctggacaggaagaaggtagatcctgtgtgtcttgttttctggtcatgtgtattgtacaagctagagagctgaatttctgagatacacattttcaaatcacatgcaagtgaagatgatggtctgtagaaattttcagtatatataatgtttaatgacatactaatttatcatctggctatttgggaaggaaggacacacatggattttgcacatttccaccatggtggctggtgtggcttgtggctatggggtgatcaccagtatcaccactttggaaggggacagtgaaattggggctagagaaggaactttgtacagttttccctgagattcagattgactgaaaagtcacatgaagagttgattgtcttttaatggtatgttttaaacagctgacattttaaattttgatgaaatccagtttattcgtttgttcttttatgctttgggtgttgcatccgagaaatcttttcccatcccaagatcacaattttttttcctttttacttctagaagtgttataattttaagctttatactttggtctatgacccgtttttttttttgttttgttttgttttttcgtttgtttctttgttttgagatggagtcttgttctgtcacccaggctggggtgcagtggcgtgatcttggctcactgcaatctctatcccctgggttcaagtgattctcttgtctcagcctcccaagtagctgggattacaggcacaggccgccacgcccggctaatttttgtatttttagtagagacagagttttaccatgttggccaggctggtttcaaactcctgacctcaagtgacccaccttggcctcccaaagttttgggattacaagtgtgggccaccgcggccagcctatgatccattttgaatgaattttttatatggtgcaaggtgtcaatccaccttcactttttcttgggaatatagatatccagctgtttcactaccattttttgaaaggactgccctttgctctatcacctttgcatttttgttaaaaagtagttgtcaatgtatatgtgggtttatttcaggactctgttttgttccattgacctgtttttctctcctgaatgccaataccatatttgtatgtagtgtatgtaattttctaataattcttgaaacagatagtattaatgcgtcatatttttgctgttgtttgtattttttgtggagatggggtttcaccatgttggccaggctgtgttgaactcctgagctaaagcaatacacttgcctcgtcctccccatgtgctgggattacaggcgtgagccttggtgctggcccagtgtaccacatttctttttgagatttgttttggctatgttaagtcctttgcttttgatgtgaaatttgggaacaggcagggtgtggtggcttatgcctgtaatcctagaactttgggaggcctagatgggtggatcacttgagctcaggagttccagaccagcccgggcctatggcgaaactccgtctctacaaaaaatagaaaaaattagccaggtgtggtggtgcatgcctgtagtcacagttacacggcaggctgaggtgggaggatcacttgaaccccagaggtcaagactgcagtgagctgagatcacaccactgtactccagcctgggtgacaaagtgagactctatctcaaaaagaaattaggatcaacttgtcaatttctacaacaacaacaacaaaaacccctgttgggcaccttgattgagattgcattgaatttatataaaactgttgggagaattgacatcttaataatattgagtcttctggcctataaacaaggtctgtcttcctaggtattaatgttttgtcttctatttctcttaataatcttttgtagttttcagtgtacaggtctaccatgtcagcatttcatagttttgatgctaaatggtattttaaaatttcaaattctaaccacttgttgctagtaaatagaaatacaattgatgttgaacttgtatccttcagccttgctaaactgtgagttctcatggtgtttttgtaaattacatcaacagtcatgtgttctatgaataaagagttttactccttc

SEQ ID NO: 52 - DNA, 1594 bp, Homo sapiens; identical to SEQ ID NO: 48

SEQ ID NO: 53 - DNA, 1603 bp, Homo sapiens
ggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaagatggactgccatggtggcataagtggcaccatttacgagtacggagccctcaccattgatggggaggagtacatccccttcaagcagtatgctggcaaatacgtcctctttgtcaacgtggccagctactgaggcctgacgggccagtacattgaactgaatgcactacaggaagagcttgcaccattcggtctggtcattctgggctttccctgcaaccaatttggaaaacaggaaccaggagagaactcagagatccttcctaccctcaagtatgtccgaccaggtggaggctttgtccctaatttccagctctttgagaaaggggatgtcaatggagagaaagagcagaaattctacactttcctaaagaactcctgtcctcccacctcggagctcctgggtacatctgaccgcctcttctgggaacccatgaaggttcacgacatccgctggaactttgagaagttcctggtggggccagatggtatacccatcatgcgctggcaccaccggaccacggtcagcaacgtcaagatggacatcctgtcctacatgaggcggcaggcagccctgggggtcaagaggaagtaactgaaggccgtctcatcccatgtccaccatgtaggggagggactttgttcaggaagaaatccgtgtctccaaccacactatctacccatcacagacccctttcctatcactcaaggccccagcctggcacaaatggatgcatacagttctgtgtactgccaggcatgtgggtgtgggtgcatgtgggtgtttacacacatgcctacaggtatgcgtgattgtgtgtgtgtgcatgggtgtacagccacgtgtcctacctatgtgtctttctgggaatgtgtaccatctgtgtgcctgcagctgtgtagtgctggacagtgacaaccctttctctccagttctccactccaatgataatagttcacttacacctaaacccaaaggaaaaaccagctctaggtccaattgttctgctctaactgatacctcaaccttggggccagcatctcccactgcctccaaatattagtaactatgactgacgtccccagaagtttctgggtctaccacactccccaaccccccactcctacttcctgaagggccctcccaaggctacatccccaccccacagttctccctgagagagatcaacctccctagatcaaccaaggcagatgtgacaagcaagggccacggaccccataggcaggggtggcgtcttcatgagggaggggcccaaagcccttgtgggcggacctcccctgagcctgtctgaggggccagcccttagtgcattcaggctaaggcccctgggcagggatgccaccctgctccttcggaggacgtgccctcacccctcactggtccactggcttgagactcaccccgtctgcccagtaaaagcctttctgcagcaaaaaaccccc

SEQ ID NO: 54 - DNA, 487 bp, Homo sapiens
  modified_base (433)..(433): a, c, t, g, unknown or other
  modified_base (471)..(471): a, c, t, g, unknown or other
aggcacatatttattttattttttttaatataaaagtaaaagagtacattgttgagtagaggattaaaggagtgacgaccctttctaaagtggggtctcccatcccggatccctaagactgtaacatctgctacatacattaaaaacaaaacaaaacaaaagcaaacatgaaacttatgacctgacttcactccacccttcatgcctgcattatgacagaaacacgtcccactgctcctacttatgtatgtacatccagagctccaaacctaagctgtggccccctcctcccagccctacccacatccaccctacttcccaaaagcctgtagaagcccccacttagaaaaaaagggcagacatacacatacacagaaacacatatctatctggcagctcctccatgtgaagcccctggaaacatacacacccngggacttttcctctccttatggcacagatgggacaggntggcctttcccctgtt

SEQ ID NO: 55 - DNA, 3158 bp, Homo sapiens
gatccctcgatcccggggctggagtggtctggcccaaggctgagaagggctgggacccccgacagtgacatgatgggctcagcccctgttccatctactgggcagggtgggcctccgcagatagcggcttcagactccagctccagggggctggcgggagtctctcaaggtgtcccacacatggtccctcggggaaagagtggagctgacccctgtcccccctcccgactcgagggccttagggccagcaggtgtgtgagggctccaggcgcgcggagccctcgaagggacaccagcccagcagcagcaggccgcggcccgggggcagccgaagaccccatccggcgcaggccaggcccgagctggcagcggcgggtccaagcctcgtcagctggcgcaggaggcccacgggcgagcgcgggacggagctgggcgccggggtccggaccgggccggggtcgagttgggcctggccggacaccggacccgccaggagccggcccctgccgcgctgggctgaggcccccgcctgcagacaaaggagccggcggggggcgggagccgggggggtggggagtgttgcaggggggatggggcgagggggcggggcgtcgcggtgtcacgttaccgcccgcagcgccctttaactcccgcccccgccccgctcaccgcccccttcccctgctacagcgcgctcgccccgcggccgccaatcagccgcgcgcgccggccgcgcgccccgccccgcccccggtgggtgtgcgcgcggccaatgggcggtgcgcgggggccgggccgcggcggggcggggcagcggggcggccgccaatcgccgtggtgttgttgaaactgaaaatactacattatgctaatcgcggccgggcccgcgcgcacgggggtggggcccgcgcgtataaagggggcgcaggcgggctgggcgttccacaggccaagtgcgctgtgctcgaggggtgccggccaggcctgagcgagcgagctagccagcaggcatcgagggggcgcggctgccgtccggacgagacaggcgaacccgacgcagaagagtccaccaccggacagccaggtagccgccgcgtccctcgcacacgcagagtcgggcggcgcggggtctcccttgcgcccggcctccgccctctcctcctctcctttccccttcttctcgctgtcctctcctctctcgtgcccgcgtttgcgcagccccgggccatgtccgacgcgtccctccgcagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccggtgagccccgcacggccccgccccggcccgggccggccccgctttgtccggccggccggtccccccagccctcgggggcctcgctgggttcccgcctcctcccgtggcattaaagggcccgcagcgctcagggcgcggctgcgcttacccccctccccgccccgttgttgtgccctccagcggcttcgcggccccgttcttctcgggtggagcggcttcgcgcgggccggggtgggaggctgaatcccggccgcgaccccccgggagcgcagttttcgcccccggccgcgggagcccctccccgggcgcgcccgcgccccgtgagcacggcgtggagggggttaagcgcggcggcggccccggggggcttggccgcgggacaaggggaaatgcttacacagcacattgcgcggcgacgtaaacaaagctgacccgccgcggacctcggcgcgggcggggacggcgcccccaccccggccggcccgcgccccgcgccctctcccggccccctctcgggtctccgggccggcccccgccctgaccggccgcgcgcctgtcgcccgcagatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaagtgagtacagcgcacctgggggggcgcggagggccgacccgccgggtccccgccggctttgctgaccgcccctctcctcgcagtttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaagaaaaaaaaaaggaaaaaataaaaaaaccatgtacaaa

SEQ ID NO: 56 - DNA, 799 bp, Homo sapiens
cgggcgaagcagcgcgggcagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaataaaagctcttcttttttaatataaaaaaaaaaaaa

SEQ ID NO: 57 - DNA, 2038 bp, Homo sapiens
gcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatcatcgaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggttttctgttggataattagcagtttagaatggaggaagaacaacaaagacatgctttccattttttcctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaaggcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaaaaaaaaaaaaaaaaaaaaa

SEQ ID NO: 58 - DNA, 2905 bp, Homo sapiens
cggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtctgcaggaaccccgaacagttccccctggtgcagggagtggccataggtggctcctatggacggaaaacagtcttaagaggcaactccgatggtacccttgtccttttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggtccaccatccaggtgttcacaaaaaatcagagaatctctttcgaggtgctggccgccttcaacgctctgagcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacagtgccagaaaaaaatcaaggatttaccctcgctgtctccgtatgccctggagctgcttacggtgtatgcctgggaacaggggtgcagaaaagacaactttgacattgctgaaggcgtcagaacggttctggagctgatcaaatgccaggagaagctgtgtatctattggatggtcaactacaactttgaagatgagaccatcaggaacatcctgctgcaccagctccaatcagcgaggccagtaatcttggatccagttgacccaaccaataatgtgagtggagataaaatatgctggcaatggctgaaaaaagaagctcaaacctggttgacttctcccaacctggataatgagttacctgcaccatcttggaatgtcctgcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccggggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctcggcatcttctggaaggtcaattacaactttgaagatgagaccgtgaggaagtttctactgagccagttgcagaaaaccaggcctgtgatcttggacccaggcgaacccacaggtgacgtgggtggaggggaccgttggtgttggcatcttctggacaaagaagcaaaggttaggttatcctctccctgcttcaaggatgggactggaaacccaataccaccttggaaagtgccgacaatgcagacaccaggaagttgtggagctaggatccatcctattgtcaatgagatgttctcatccagaagccatagaatcctgaataataattctaaaagaaacttctggagatcatctggcaatcgcttttaaagactcggctcaccgtgagaaagagtcactcacatccattcttcccttgatggtccctattcctccttcccttgccttcttggacttcttgaaatcaatcaagactgcaaaccctttcataaagctgccttgctgaactcctctctgcaggagccctgcttaaaatagttgatgtcatcactttatgtgcatcttatttctgtcaacttgtatttttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccaggccaaccctttcattagaacttcaagctctccaaaggctcagattataactgttgtcatatttatatgaggctgttgtcttttccttctgagcctgcctttatccccccacccaggagtatcctcttgccaaagcaaaagactttttccttggctttagccttaaagatacttgaaggtctaggtgctttaacctcacataccctcacttaaacttttatcactgttgcatataccagttgtgatacaataaagaatgtatctgg

SEQ ID NO: 59 - DNA, 597 bp, Homo sapiens
agctgaagttgaggatctcttactctctaagccacggaattaacccgagcaggcatggaggcctctgctctcacctcatcagcagtgaccagtgtggccaaagtggtcagggtggcctctggctctgccgtagttttgcccctggccaggattgctacagttgtgattggaggagttgtggccatggcggctgtgcccatggtgctcagtgccatgggcttcactgcggcgggaatcgcctcgtcctccatagcagccaagatgatgtccgcggcggccattgccaatgggggtggagttgcctcgggcagccttgtgggtactctgcagtcactgggagcaactggactctccggattgaccaagttcatcctgggctccattgggtctgccattgcggctgtcattgcgaggttctactagctccctgcccctcgccctgcagagaagagaaccatgccaggggagaaggcacccagccatcctgacccagcgaggagccaactatcccaaatatacctgggtgaaatataccaaattctgcatctccagaggaaaataagaaataaagatgaattgttgcaactcttaaaaaaa

SEQ ID NO: 60 - DNA, 9618 bp, Homo sapiens
tgggccaagcttagtatacctagagtgtataggcaagggaaagagagagatgactgagggaaagcgagaatccactgagacagtagctctcactttgcctgacctgctagcttcctctcttgtcctggtgttgacccattttggacctcaggccagctggctccagggctgtgcttgtgcctgctctgccatccccatgtctacatcgctcagggctcccagcccactgtgctgctcagtggtgtatatttcacttaccttaaggcccaacgacttggaaacacatccagaaagtctgctagaggatgcctgaatggtcaaggtcatctcagtcagggcacccagggccacattgctccctgcagtccttccccacatagcttgagaaatggctgccccaggagggtgcaagggtgcaagggtgcaggggttcactgattactggggagagaacaagttcaattccatggttaaagaagaaaaatgcaaattgaatacctggcccaaggaggttcctggtcccaccccatgccacccttgccctgggatgtactctccttatggtctgacctatgagatctcagtggactctatcctcagaaatcacagagtccaggattgcaaactggaggccctgctgtgaggccctgcccacaggtgggtcttgcctggcctgtagagagctggctctctcacttccacacatccccaccattccccaccgtggcaccatggagtcttccttacctgatctaggaaggcggcgctggagcttgctgccccctgtctgatccagcccctcatgttgtaggagggaggtgggcgactgaagctcagagagggagtaaatgagctcaacttcacacagctagtgaggggctggttggagaccagattttccaagtggttccccgggccctcggggagcagcaagggccaggcgaacctccatgcactgcacaaacatgaagaagtgaaccctcttggggttccccaggtgggaagtggggtgtcttcttgggagggggtgaaccaacttctggtgagttttccttgttgaagcaatgctgcacccgtagcctgtttgttaataattacctggtcgggagagagtgggtggtactgagaaggcctggtttgaccagtcctcctgggcttgataagacagagctgagacagccacccagggggtccactccaggacagactgtgccgtgagtaaccccttgagacaatggagacgagagactctagagggagggtgaccaactgttccactttgcccaagactgataattcttctgggatatattttcagtgctaaaaccaggaaagtcccaggcaagctgggacactttgtcactcttgctagaggtgagaaatactcaggctagaaaggccctgacttagggtccatgggcactggtgggtgactatgcccggagacccagaaaagcctcccccagggacacacagctggtacagggcggcactgactgagggccaaggtcttctggctgccaatccaggtgatcttggggagctcatgccggaggggaggtgtgtctgtgagtgatgcggtcctatgtatgtttctaaatgatccctccaactgctgagtggagaacagagagcagaaagactaggaagctttctgcaagggtctaggtcaggggtcaacaaaccacagcttgtaggtcaaatccggcccaccgcccatgagctaagaatgcaagatgtaaatataaatataaaatataagtgataagtataaaagataaatatataaagctatgaaaaatcaatagaagaacaacattttgtgacacaggaaaataatatgaaattcacatttcagtgtccgtaagtgaagtttcactgaaacacagccacgcctcttcatgcatgtccggtctgtgctgtttccagctgccacagcagagttgggtagtggcagcagagactgtgtggtctgcaaaaccacagatattactatctggcgctttgcagcaaaagttttctgagccctggttgaggatcatagcaaaagagggggcgagaggctgaagaacctacaggagagtctaggagttggagaccagcttgggcagcatggtgagaccccgactctataaaaaattagctgggtgtggctgtgcatgcctgtagttccagctacttggaagggtgcatgcctgtagttccagctacttggaagggtgaagtgggaggatcacctgagctcaggaagtcaaggctgcagtgagccatgattacaccactgcactccagcttgggtgacagagtgagaccctgtctcaaacaaacaaacaaacaaccaaacaaacaaaaaaaacccaaccctgcaggtcatggaagtggattaaatggattttgggtggatagaagcctagaagctttttggcctgacaaccggatactggtgggaccatttgatggggcaggagcagatttgggggagaaactggagtatcctttcttggacagatgttcattatgaaacgggtaccaattctatccccacaactttgggcaggtcacttattaaacatccatgtccttgtctgtacggggtaacaatacaaagaccagttctactgacctctacaggggtgggagggtcaaactaaatggctgaaagtggtttgtaaaccatataaagcactccacagatgtttgtggaacagaccctaaaataaactctgaggatagccatcctccatgcaaaatcactgcactaatgaaatcaactcatctgaaagacaagtgtgggagaagcagcacctgagtctggggatgtgggttctggctgggatatgtgctaggtaggtgacttgggtgagtcactttgggagtcttcatttcctgctctgttgggtgagaatggagtctagtgctgtgcagagctcacacaggtgggaaacacaatgacatgatggacacaaggagtgtgccttgtaagtctaaaacattgccatccaatagtgttgctgtcaccatacatgtggaaggtggtgggtgttacattgcctttcacaagcccatctgcaggagttgagggtgtcactcacgatctccgggtgctggcccactgccagccttctcagtagggccaggtgttcttctgggggaatttcctgggcattctcttccctcccataggcctgagagtgcagaggatgcatcttatcgactacctgctcctcctgctggttggactactggccctttctcatggccagctgcacgttgagcatgatggtgagagttgcagtaacagctcccaccagcagattctggagacaggtgagggctcccccagcctcaagatagcccctgccaatgctgactttgccttccgcttctactacctgatcgcttcggagaccccggggaagaacatctttttctccccgctgagcatctcggcggcctacgccatgctttccctgggggcctgctcacacagccgcagccagatccttgagggcctgggcttcaacctcaccgagctgtctgagtccgatgtccataggggcttccagcacctcctgcacactctcaacctccccggccatgggctggaaacacgcgtgggcagtgctctgttcctgagccacaacctgaagttccttgcaaaattcctgaatgacaccatggccgtctatgaggctaaactcttccacaccaacttctacgacactgtgggcacaatccagcttatcaacgaccacgtcaagaaggaaactcgagggaagattgtggatttggtcagtgagctcaagaaggacgtcttgatggtgctggtgaattacatttacttcaaaggtgagagtcagatcattggtatatgctaaatccacaccaccgcctccaacccactaatttgttgactggttaaatatatttttacaaaaatgtaagtaaaaacgttgtgtctgatagggttgagcaaccctcagggaatgcaatgtgagaatgttgtatgttgaagactctgtagtattgaggtttccattccttcctatctttagacatattttcttcataaaaataatgtataaaatgcattatagccagtgatcattagttgaattgctggattcatatctgagctcagcctctaccaacagtgcaaacaggtcagcttgtttgctcaaagcagggataagacaagtctctaattcaaaggttggctttgaggatcaaatgattaacccatgtatatactccttagaaaagggtctaaagagatgggcaaactacagcccatgggccaaatgtgttcagccactggttttgtaaataaagttttattggcacacagccaggcccattcatttatgtattgtctgtggctgacttcatgctacaatggcaggttgattcattactgcagagattgaatgatctgcaatgcctaaaatagttaatatctctataaaccttttggtttgttgacccctgaccattttatgtactcaataaatagcaactataattcatctaatgataacaatgctcattttgaagctttaaaaatatgtaaaagcataaaggagaaagtagacataatctctagtcctaccactcagaggcaacaaatgttaatgttttagcatcttttcttcaccttccattcacacacatatatgtccacacagttgattttgcagtgtgcaaacaactttgtacggtgtgtattagccagggtttcatcagagaaggagagccacctcaagtcaatggtaaggagatcattataggaattaggccccacacaattgcggctgggaaagtgaaggtctagaggaaagaagagttggaaggacagagagaaagttgccaatgtaagcggacaagtcagagcttagaggggaatctatatgccaggctcaaccagccatcagagtgctgccatggaggggagcatcactgcatagtttctgtggtagcctggggctgctgttgtttagtggggttagacttgggaaatgagcttggagacaagcagggcaaactggagcacacagagcactgctgagtctaccatcatcatatctgactaccagggccttcagagggcaatctacttcgaaatctcacagttctaaccagcttgaacccaaaatctacagggaacaaaattctagggagcaactcccagcctaatgattcagccaaattagtcatcccatgtaatttgcatgtggaattttcatgaaccattgaaaagtttttttaaaaaagctttgttttgaggctgggcatagtggctcacacctgtaattccagcactttgggaggccaaggcaggtggatattgaaatcagaagttcaagaccagcccggccaacatggcaaaaccctgtctctactaaaaatacaaaaaaaaaaaaaaattagccaggcttcatggcacatgcctgtaatcccagccacttgggaggctgaggcaggagaatcgcttgaacccaggaagtggaggttgctgagattttgccaccacactctggtctgggtgacagaatgagactctatctccaaaaaaaagttttgctttgaaataacaaaacttttaaactttataaaaaaaattaactaaggaaggaagagaaacagtagtatgggtttcactgtcaggaagacattggttagaatcccagatcccttgctattccctggactaaaattcctggcatggaggccttagtccattcaccctacctgccaccacctcactgcacatcgcctcctgtatttgcttccctcctcacactgcagcgattccatggccatcattgtggtcacttccttgcaaacactctgaactcttaacttccttggttttccctccctctatcatacttaccctccaaagctgcaaacctgattaaacctaaaggtctaactagtctacatctgcacccagcagctgaatgtggttgaagaaaaacatccaacggggctgatggtctcacttgatatttgtgaatgcaaattttcattgatatctctacactgtccagcaatcctacctacatatctccactctccaaaacaactataataacagattcgtccttctcaaatgtcctccccactcatgactttcacttaacaatcttgtctcacttttcattgagaaaacagaatcagttaaacaggaaatctctcatcttctcacctccaaatctactcacctccaaatcttctcacctccaaatctactcgcctccctgcatttgaacccacaagctcagatgccctcctctcatcatggcagtagtgacccacctcttatggaaggctgacccctctgctcacactctgccatctcctctctccttctcaaggatgctcacctaacaatgaaactctctttccagcaccccttgtttcttctctatcaatcctactcacatattagaaaacgaacatcctctgctatctctcattttaaaatttaaatgaggcctaaaggatccattccccaggcatgtcaggttttgaatggtcaaaatgggacatcttgatgggctcatagggcaggatctggagcgactgtttctgtagctcagaacaccagatggcattccctggctggaggactagctctgtggcctgcagatgtcctgtaccttcttttcatcttcccttcagccctgtgggagaaaccattcatttcctcaaggaccactcccaaagacttctatgttgatgagaacacaacagtccgggtgcccatgatgctgcaggaccaggagcatcactggtatcttcatgacagatacttgccctgctcggtgctacggatggattacaaaggagacgcaaccgtgtttttcattctccctaaccaaggcaaaatgagggagattgaagaggttctgactccagagatgctaatgaggtggaacaacttgttgcggaagaggtaatcagtgtgctatgggggctgaatctacagtactatccatcaaatgtaactttctaatgaaagacagtgccccaaaatagagagtgaacaccaaattatgagagaattctcacttgctctgagaacttccatgggcttcctttaaatgatgaactctcctgttatatttaaaatatgacttccccctctttaggcaaaaaagaaccacagtaggagttcagagtcctgggttctagacatagctcttccactgcacaagacttgggtcaagtgactcttcctctctggggggttacctctgtgcaatgaagaggtagcccttctggcccagaaggttgactaagctgccatagtgggacttaaaaaaactccatccacctacccaaggaattaataggaaggcttcccatcactctggttatgattggaaaaagtcttcaaccatatataagaaaaggatcctagcccaagggcacatgtggatagaaaattcacacagctttcatgatggagagaatccaatccaaagaaattagctggttcaaaaagaataaaacccacagggctataacagaggcaaaggcaaaactgccacctggcgaggcttacatctgtctccctgggcacctgaacacccacaggaagcaacctctgaagaggggttcccaaggacgggagatcccacagacagcagggcctgggtacaaaggaacctggcctttcaacatccatttgtgggaggtggtctgagccgaagctgtttgtggggacagaactcagatggaatagagccagctagagagggccaccaaggagggctctgcccagcagggatcctggcttgttcattaatctaatgttctaactcaatgcccctttcaggaatttttacaagaagctagagttgcatcttcccaagttctccatttctggctcctatgtattagatcagattttgcccaggctgggcttcacggatctgttctccaagtgggctgacttatccggcatcaccaaacagcaaaaactggaggcatccaaagtaagtcgtcaacagtcagcaatccctagagaactcggtagggcagtgcccatgggagctgccaggcgatggggctcccaagctgccacatggagtctcagagcctgagtgtgttcagtcatctacaggcatcagcatccaccaatcaaccagccctggacgtggtgctaggtgctggagatatagtgttgaaccagcccctgccctcagagagctctcccagtctagtcagggacacagcgtcttcatagagagataaacgcaatgatagaaaatggaggaggggccgggcatggtaactcatgcctgtaatctcagcactttgggaggccaaggcaggcagatcacttgaggtcaggagtttgagaccagcttggccaaaatggtgaaactccaactctactaaaaatacaaaaattagaatggtgtggtggcgggtggtgggcacctgtaatcccagctattcaggaggctgaggtaggagaattgcttgagcctgggaggcagaggttgcaatgtgaccagagatcaggccactgcactccagcctgggtgacaaagtgagtgagactccatctcaaaaaaaaaaaaaaagaaaaaatagaggaaacagagaggagagacacaggtgaggctgcattgggtgcgtctatattagggagactttgcagataagagaaagagactcaagacttctgataagaaaagtgcacgagggggtagagccttgggttcaagcttgaattccagttcttcctcttatggttattgaaggagtactagtttctgaatttattttcctcacttttaaaatggacatcatactgctgacctcttaggatggccatgaagatcaaataagatgcatgcaaagccccgggcacagagcaagtgctcatttaatgagagctaccatgattgtgtgtggcaggaggtctctagctcaaaaatccgcccaaatgaaattcttgctgtgttatccccaagaaatggccttgcaggctgttatgtgcaatattattccctagcaatttctggctctcgcagtcttgtccaggccccctctcttgctggcttggagataatgcttgtgattttcctcccagagtttccacaaggccaccttggacgtggatgaggctggcaccgaggctgcagcagccaccacgttcgcgatcaaattcttctctgcccagaccaatcgccacatcctgcgattcaaccggcccttccttgtggtgatcttttccaccagcacccagagtgtcctctttctgggcaaggtcgtcgaccccacgaaaccatagccctcccagggctgctcatctgttccaagcaggaggatgtggcaggggagggctgggagtgagtagctctgtgtttagagttggggacaaggatgacaccgaagtccaggagtccaggacagcaggtgctggccggtggggagcggggaggggcactgagatgggcagggcctggacattccacaccctggtgctgtgcagcctctggcagagcatccgacctcttggagcaagtttctgcctctggaaagggggcgggcccttttcacaacaggctggttgtaccgagtaaacaacacgatgccatg

SEQ ID NO: 61 - DNA, 1940 bp, Homo sapiens
aggcctgctcactcctcagctgcaggagccagacgtgtggagtcccagcagaggccaacctgtgtctcttcatctccgtgagaaaggtgcccccgaagtgaaagagatggcctggtggaaagcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtatccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagaggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaatgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 62 - DNA, 1934 bp, Homo sapiens
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagccccaggctggagataacagcctcttgcccgtcggccctgcgtcggccctggggtaccatgtgccacaactgctgtggccccctgtccccaagacacttccccttgtctccctggttgcctctcttgccccttgtcctgaagcccagcgacacagaagggggtggggcgggtctatggggagaaagggagcgaggtcagaggagccggcatgggttggcagggtgggcgtttggggccctcatgctggcttttcaccccagaggacacaggcagcttccaaaatatatttatcttcttcacggg

SEQ ID NO: 63 - DNA, 604 bp, Homo sapiens
tattgagatattcactttattgcagtggtctgaaactgaacccacaataactacaaggtatgcttgtaaataccttatttttaacaaaaagtgaaaatgatttccctgttatttactaacaaatagaccagacatttgcatcagacagtgagcataaacttctctgatcacctctcaagagacatctcccatttctcttttgactctcctcaagatttcctgtaagaccaaactttatcttccatatgtctcacaggtcagtgttcataataaccatcagttatacaacagcaatttaatgaatctcagagtgaagacaaattgccggtttctgagtagagggccaggataggtcacctggatactcattgaaactaatgattctcaacttctcctgccttcaactcaccagaggaatattagacatccacttgttagtggttctctatgggggatagtagaggaaagccaaatttgggcattaatagaacaaatcttatgttaaatcctcgtattatttttctgagataatatgactacagctcagatataacatatcccattttaactacttcaaacccagtaatccatatattctcactac

SEQ ID NO: 64 - DNA, 2850 bp, Homo sapiens
gttgtgactttccctttcgaattcctcggtatatcttggggactggaggacctgtctggttattatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgagagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtaagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatagactacggaaagaagtggtggacacaagcccaagcccacgacctggtcatcaaaagccttgacaaattgaaggaggtgaaggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcaagaccatcctggctaacacagtgaaaccccgtctctactaaaaatacaaaaaattagccgggcatggtgcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcgttggggtggttgtcatgtgatgggtccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactca

SEQ ID NO: 65 - DNA, 1157 bp, Homo sapiens
ccccagcggaggtgaaggacgtccttccccaggagccgactggccaatcacaggcaggaagatgaaggttctgtgggctgcgttgctggtcacattcctggcaggatgccaggccaaggtggagcaagcggtggagacagagccggagcccgagctgcgccagcagaccgagtggcagagcggccagcgctgggaactggcactgggtcgcttttgggattacctgcgctgggtgcagacactgtctgagcaggtgcaggaggagctgctcagctcccaagtcacccaagaactgagggcgctgatggacgagaccatgaaggagttgaaggcctacaaatcggaactggaggaacaactgaccccggtagcggaggagacgcgggcacggctgtccaaggagctgcagacggcgcaggcccggctgggcgcggacatggaggacgtgtgcggccgcctggtgcagtaccgcggcgaggtgcaggccatgctcggccagagcaccgaggagctgcgggtgcgcctcgcctcccacctgcgcaagctgcgtaagcggctcctccgcgatcccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagtcggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgc

SEQ ID NO: 66 - DNA, 1199 bp, Homo sapiens
actcccaacgagcgcccaagaagaaaatggccataagtggagtccctgtgctaggatttttcatcatagctgtgctgatgagcgctcaggaatcatgggctatcaaagaagaacatgtgatcatccaggccgagttctatctgaatcctgaccaatcaggcgagtttatgtttgactttgatggtgatgagattttccatgtggatatggcaaagaaggagacggtctggcggcttgaagaatttggacgatttgccagctttgaggctcaaggtgcattggccaacatagctgtggacaaagccaacctggaaatcatgacaaagcgctccaactatactccgatcaccaatgtacctccagaggtaactgtgctcacgaacagccctgtggaactgagagagcccaacgtcctcatctgtttcatcgacaagttcaccccaccagtggtcaatgtcacgtggcttcgaaatggaaaacctgtcaccacaggagtgtcagagacagtcttcctgcccagggaagaccaccttttccgcaagttccactatctccccttcctgccctcaactgaggacgtttacgactgcagggtggagcactggggcttggatgagcctcttctcaagcactgggagtttgatgctccaagccctctcccagagactacagagaacgtggtgtgtgccctgggcctgactgtgggtctggtgggcatcattattgggaccatcttcatcatcaagggagtgcgcaaaagcaatgcagcagaacgcagggggcctctgtaaggcacatggaggtgatgatgtttcttagagagaagatcactgaagaaacttctgctttaatgactttacaaagctggcaatattacaatccttgacctcagtgaaagcagtcatcttcagcgttttccagccctatagccaccccaagtgtggttatgcctcctcgattgctccgtactctaacatctagctggctttccctgtctattgccttttcctgtatctattttcctctatttcctatcattttattatcaccatgcaatgcctctggaataaaacatacaggagtctgtctctgctatggaatgccccatggggctctcttgtgtacttattgtttaaggtttcctcaaactgtgatttttctgaacacaataaactattttgatgatcttgggtggaaaa

SEQ ID NO: 67 - DNA, 879 bp, Homo sapiens
  modified_base (639)..(639): a, c, t, g, unknown or other
agtacaggagcttgtgccgtggcccacagcccacagcccacagccatgggtgggacctgacggtgaagatgctggcgggcaacgaattccaggtgtccctgagcagctccatgtcggtgtcagagctgaaggcgcagatcacccagaagatcggcgtgcacgcgttccagcagcgtctggctgtccacccgagcggtgtggcgctgcaggacagggtcccccttgccagccagggcctgggccgagcagcacggtcctgctggtggtggacaaatgcgacgaacctctgaacatcctggtgaggaataacaagggccgcagcagcacctacgaggtgcggctgacgcagaccgtggcccacctgaagcagcaagtgagcgggctggagggtgtgcaggacgacctgttctggctgaccttcgaggggaagcccctggaggaccagctcccgcttggggagtacggcgtcaagcgcctgagcaccgtgttcatgaatctgcgcctgcgggaagcggcacagagcctgcgggcggactaagggcctccacagcatccgacaggatcagggcggaaataaggctgttgtaagagagaaaagagaaaaaaaagttcttgataacggcgaggctaatccgttgntaggtaatttacttgcatgccgctgtttaaatgtactggaactggcgtacaactatcgctgagaaccgttccgatggtatagaagccgccgtgcgtctaaatccatgatgcatgcgcctttgcgcttacgtgggagttgttcgggattacgcggtttttctttgaggccgaaaagcgttggtttcccaaaagggtgcctgattttgatagtcacaacttgtgtaaaaaatttggtttacc

SEQ ID NO: 68 - DNA, 2961 bp, Homo sapiens
aagagatgatttctccatcctgaacgtgcagcgagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgtgctggaggcactgtcaggagtcgcgcttcccagaggcagcggaatcgtaaccaggtgtccgctggtgctgaaactgaaaaagcagccctgtgaggcatgggccggaaggatcagctaccggaacaccgagctagagcttcaggaccctggccaggtggagaaagagatacacaaagcccagaacgtcatggccgggaatggccggggcatcagccatgagctcatcagcctggagatcacctcccctgaggttccagacctgaccatcattgaccttcccggcatcaccagggtggctgtggacaaccagccccgagacatcggactgcagatcaaggctctcatcaagaagtacatccagaggcagcagacgatcaacttggtggtggttccctgtaacgtggacattgccaccacggaggcgctgagcatggcccatgaggtggacccggaaggggacaggaccatcggtatcctgaccaaaccagatctaatggacaggggcactgagaaaagcgtcatgaatgtggtgcggaacctcacgtaccccctcaagaagggctacatgattgtgaagtgccggggccagcaggagatcacaaacaggctgagcttggcagaggcaaccaagaaagaaattacattctttcaaacacatccatatttcagagttctcctggaggaggggtcagccacggttccccgactggcagaaagacttaccactgaactcatcatgcatatccaaaaatcgctcccgttgttagaaggacaaataagggagagccaccagaaggcgaccgaggagctgcggcgttgcggggctgacatccccagccaggaggccgacaagatgttctttctaattgagaaaatcaagatgtttaatcaggacatcgaaaagttagtagaaggagaagaagttgtaagggagaatgagacccgtttatacaacaaaatcagagaggattttaaaaactgggtaggcatacttgcaactaatacccaaaaagttaaaaatattatccacgaagaagttgaaaaatatgaaaagcagtatcgaggcaaggagcttctgggatttgtcaactacaagacatttgagatcatcgtgcatcagtacatccagcagctggtggagcccgcccttagcatgctccagaaagccatggaaattatccagcaagctttcattaacgtggccaaaaaacattttggcgaatttttcaaccttaaccaaactgttcagagcacgattgaagacataaaagtgaaacacacagcaaaggcagaaaacatgatccaacttcagttcagaatggagcagatggttttttgtcaagatcagatttacagtgttgttctgaagaaagtccgagaagagatttttaaccctctggggacgccttcacagaatatgaagttgaactctcattttcccagtaatgagtcttcggtttcctcctttactgaaataggcatccacctgaatgcctacttcttggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggttgttttcttgtgcgtactcattcattctaaggggagtcggtgcaggatgccgcttctgctttggggccaaactcttctgtcactatcagtgtccatctctactgtactccctcagcatcagagcatgcatcaggggtccacacaggctcagctctctccaccacccagctcttccctgaccttcacgaagggatggctctccagtccttgggtcccgtagcacacagttacagtgtcctaagatactgctatcattcttcgctaatttgtatttgtattcccttccccctacaagattatgagaccccagagggggaaggtctgggtcaaattcttcttttgtatgtccagtctcctgcacagcacctgcagcattgtaactgcttaataaatgacatctcactgaacgaatgagtgctgtgtaagtgatggagatacctgaggctattgctcaagcccaggccttggacatttagtgactgttagccggtccctttcagatccagtggccatgccccctgcttcccatggttcactgtcattgtgtttcccagcctctccactcccccgccagaaaggagcctgagtgattctcttttcttcttgtttccctgattatgatgagcttccattgttctgttaagtcttgaagaggaatttaataaagcaaagaaactttttaaaaacgt

SEQ ID NO: 69 - DNA, 367 bp, Mus musculus
ctggcacggacatggctgtcttctgtctgctgtgtgggaaacgctttcaggcacaaagcgcactccagcagcacatggaggtccacgcaggcgtgcgcagctatatttgcagtgagtgcaaccgcaccttccccagccacacggctctcaagcgccaccttcgctcacatacaggtttttttctccatgtgtcaccaagtgaagtttgtgccttctatagcaaagagaatattttttacatcctactaacagtagatttttttgtagtgaacattttttgtatttttatttataagtctcataagaaaaatagcgatgttcagttgtataccttgaatctgcagttagaagagaataaagttaactc

SEQ ID NO: 70 - DNA, 354 bp, Mus musculus
ctgcagcattttaatctgaagtctctggttgaccctaaggatatcgacctcagccctgttacaattggctttggcagtatcccacgcgaatttaaactctgtgtcattcctcgttcatgagacctgctgccatcattatccctcacaaaatgactgtttaaaaaaatgccaagcgggctggtgagatggctcagtgggtaagagcacccgactgctcttccgaaggtccggagttcaaatcccagcaaccacatggtggctcacaaccatctgtatcgagatctgactctgtcttctggagtgtctgaagacagctacagtgtacttacatataataaataaataagtctttac

SEQ ID NO: 71 - DNA, 1560 bp, Mus musculus
tgagttctcgtaaactccagagcagcgataggccgtaatatcggggaaagcactatagggacatgatgttccacacgtcacatgggtcgtcctatccgagccagtcgtgccaaaggggcggtcccgctgtgcacactggcgctccagggagctctgcactccgcccgaaaagtgcgctcggctctgccaggacgcggggcgcgtgactatgcgtgggctggagcaaccgcctgctgggtgcaaaccctttgcgcccggactcgtccaacgactataaagagggcaggctgtcctctaagcgtcaccacgacttcaacgtcctgagtaccttctcctcacttactccgtagctccagcttcaccagatctcggaatggaccccaactgctcctgctccaccggtaagactcccgatccttggtctttagaataccaagttgggaccgcagagcggaatccccgagttgtagaggcttggcgggaataggcacctttagttggcgattcattccggttctttctagaatccgctcttgcaaaagccttcattagttacgagtattgtcgaacgggtcctttggcggggttggggctaggatttagacgcgcaaatgtccggttcctgatcacccagttagtggggacatctgggttgagtcccaggcattactaaacttactgtgaattgcttgaattaagaaagaggtgaaggacctttatgtcttgggactcaaagacataatccctgacttaacctgtgaggagaaaagtggggctaggctccctgcagctccgaggaggacttagtgaactgagccgggactcgtggtgttggccactgctgtaatgctgcctccctcatgctgtcttctttctcctcccaggcggctcctgcacttgcaccagctcctgcgcctgcaagaactgcaagtgcacctcctgcaagaagagtgagttgggacaccttgggtggcggctaaggctaggggcggggaactcctacaaaactggctctgagaaatgtcctttgcttcccggaggccattgtattgtctcggggacagaactatacagagaactatttaaaaaaaccgaggtcttctctgttggggacaggaagcagaggtcttcagccaggctgcctcttcctccttcttctaggctgctgctcctgctgtcccgtgggctgctccaaatgtgcccagggctgtgtctgcaaaggcgccgcggacaagtgcacgtgctgtgcctgatgtgacgaacagcgctgccaccacgtgtaaatagtatcggaccaacccagcgtcttcctatacagttccaccctgtttactaaacccccgttttctaccgagtacgttaataataaaagcctgtttgagtctaactctggtttcttggtgtggtttggcaataagaaactggggtgacttgatagtctggggatctggttttggaccccctcgtgcctttacctccgccctctggccctcacagaggggtaatgtctttgggtaaagccaagctatatcccataagcttcctcatggaaaacagctg

SEQ ID NO: 72 - DNA, 120 bp, Mus musculus
gtgggtaacttgtgtgaatttgtgacagtctggctaaatgagccattcctggcaacctgtgcatcaaaagggctgaagtcaagttgagctcctaaaatggatgtgggtgcaaactttgaa

SEQ ID NO: 73 - DNA, 321 bp, Mus musculus
tttttttttttttttttcttaaaaatataaatgtatttgtctgcatcatgacgttcttcgggcacctagctggccagaccactggccatgggacaaggaggaagtcaggtgtaagtctgagcaaggaacaggactctgccctggcagggtggaggtggcctcacagtgtcccatgctgggcctggtagcgtgaaagcacagcacggtagtgggacagctcctgccgcacagccaccacctcctgccgcaacagggcgttttccttctccaggaaggcagcccgcacagatatccggttctccttgagtcttcttgcatctc

SEQ ID NO: 74 - DNA, 1408 bp, Mus musculus
gacagggcgccctcggaaggacaggatgtcatcaggaaaacaggactccccgtgggaagataggatacctccaggaagatagaatagtcccaggcatcactagaacagcaggaaacactagggtccaagctctcattgaggcacccggggaggttgttgggttgtgggcggggctcaggaaagactgtccctgctggtcctgatccacgaccacccacccggcaaggttctctctaagagaaccttgtcagagacagaacgggtccctacaggcgcgttcttctctcctacagcccatggcgcggttcctgaggctttgcacctggctgctggcgcttgggtcctgcctcctggctacagtgcaggcggaatgcagccaggactgcgctaaatgcacgtaccgcctggttcgcccaggcgacatcaatttcctggcgtgcacactggaatgtgaaggtcagctgccttctttcaaaatctgggagacctgcaaggatctcctgcaggtgtccaggcccgagttcccttgggataacatcgacatgtacaaagacagcagcaaacaggatgagagccacttgctagccaagaagtacggaggcttcatgaaacggtacggaggcttcatgaagaagatggacgagctatatcccatggagccagaagaagaagcgaacggaggagagatccttgccaagaggtatggcggcttcatgaagaaggatgcagatgagggagacaccttggccaactcctccgatctgctgaaagagctactgggaacgggagacaaccgtgcgaaagacagccaccaacaagagagcaccaacaatgacgaagacatgagcagcaagaggtatgggggcttcatgagaagcctcaaaagaagcccccaactggaagatgaagcaaaagagctgcagaagcgctacgggggcttcatgagaagggtgggacgccccgagtggtggatggactaccagaagaggtatgggggcttcctgaagcgctttgctgagtctctgccctccgatgaagaaggcgaaaattactcgaaagaagttcctgagatagagaaaagatacgggggctttatgcggttctgaagcccttttccagcagtgaccccgacccccactagcctgctccatcccccatgagcaactgccttgtcaatgatgtttcttgtcacatgctgctttgtgctgtacagttgcccccgtggtctagataactacactgcctgaaagctgtgattttagggtctgtgttcttttgagtcttgaagctcagtattggtctcttatggctatgttgttatcaatagtttgttacctcatctctcctgacgaaacatcaataaatgcttatttgtatataaatataataaacccgtgaccccaactgc

SEQ ID NO: 75 - DNA, 698 bp, Mus musculus
cctgagaagacttagccttgcagctgtgctcagccctaaatagttcccaaaatttgcatgctctcacttcctatctttgggtactttttcatataccagtcacattgtgagccattgtaattgaagtcaagactcagcatggacatgatgtcctctgctcagttccttggtctcctgttgctttgttttcaaggtaaaattgactataatgggaatttgctgttgcacgatggtgattcttgttgactggcgttttgaaggggtcctttcttttcctgcttaactctgtgggtattttttatgtctccactcctaggtaccagatatgatatccagatgacacagactacttcctccctgtctgcctctctgggagacagagtcaccatcagttgcagggcaagtgaggacattagcacttatttaaactggtatcagcagaaaccagatggaactgttaaactcctgatctattacacatcaggattacactcaggagtcccatcaaggttcagtggcagtgggtctggggcagattattctctcaccatcagcaacctggaacctgaagatattgccacttactattgtcagcagtatagtaagcttcctcccacaatgatataagtcataacataaacctccatgaaagcagaagtgtgtggtttggcttctccagatgttcctcatggtgaaac

SEQ ID NO: 76 - DNA, 362 bp, Mus musculus
tctggtgcctgtgcagacattgtgatgacacagtctccatcctccctggctatgtcagtaggacagaaggtcactatgagctgcaagtccagtcagagccttttaaatagtagcaatcaaaagaactatttggcctggtaccagcagaaaccaggacagtctcctaaacttctggtatactttgcatccactagggaatctggggtccctgatcgcttcataggcagtggatctgggacagatttcactcttaccatcagcagtgtgcaggctgaagacctggcagattacttctgtcagcaacattatagcactccgtggacgttcggtggaggcaccaagctggaaatcaaacgggctga

SEQ ID NO: 77 - DNA, 765 bp, Mus musculus
gctagaatttttcaaataaccttctaaaatgacatctgtaattttaaaaccttaaaaatgaagttgatctccaaagccatatgttcacctgaccttgggccaaagaggggtcactgtgcctgtgctaatcctgagaagattagccttgcagctgtgctcagccctaaatagttcccaaaaatttgcatgctctccacttcctatcttgggtactttttcatataccagtcagattgtgagccattgtaattgaagtcaagactcagcctgacatgattgcctctgctcagttccttggtctcctgttgctctgttttcaaggtaaaatttactacaatgggatttgctgttgcacagtgattcttgttgactggaattttggaggggtcctttcttttcctgcttaactctgtgggtatttattatgtctccactcctaggtaccagatgtgatatccagatgacacagactacatcctccctgtctgcctctctgggagacagagtcaccatcagttgcagggcaagtcaggacattagcaattatttaaactggtatcagcagaaaccagatggaactgttaaactcctgatctactacacatcaagattacactcaggagtcccatcaaggttcagtggcagtgggtctggaacagattattctctcaccattagcaacctggagcaagaagatattgccacttacttttgccaacagggtaatacgcttcctccacaatgatataagtcataacataaacg

SEQ ID NO: 78 - DNA, 299 bp, Mus musculus
acttgcggttaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttcctcagacgttcggtggaggcaccaagctga

SEQ ID NO: 79 - DNA, 250 bp, Mus musculus
  modified_base (225)..(225): a, c, t, g, unknown or other
atcctccctggctatgtcagtaggacagaaggtcactatgagctgcaagtccagtccaggacagtctcctaaacttctggtatactttgcatccactagggaatctggggtccctgatcgcttcataggcagtggatctgggacagatttactcttaccatcagcagtgtgcaggctgaagacctggcagcttacttctgtcagcaacattatagcactccgctnacgttcggtgctgggaccaagctga

SEQ ID NO: 80 - DNA, 341 bp, Mus musculus
gaggtgaaactgatggagtctgggggaggcttagtgcagcctggagggtcccttaaactctcctgtgcagcctctggattcactttcagtgattacgaatggcgtgggttcgactggctccaaggaaggggcctgagtgggtagcaagcattagtaatttggcatatagtatatattatgcagacaatgtgacgggccgattcaccatctctagagaaaatgccaagaatatactgtacctggaaatgagcagtctgagatctgaggacacggccatgtatcactgtgtaagacgggacgtcggggctatggactactggggtcaaggaacttctgtcacc

SEQ ID NO: 81 - DNA, 1400 bp, Mus musculus
gggccccggggcaccgcaaagggcgcgcgcgggagcaagcaggtgtcctggaaccggttcccaccggatcgcagaccctttgcgctcagctcctttgctctcagtccctgagcccagagaaagggggtgtgactcagcgcggggggtggggggagggcgtgtgcaggctctgtcccacgagcaaaaagagggccgcttgcagaattcgggtcgtgcgcaggcccaggggcgtgtgctggccatatcccttgagccagaaaaagggcgtgtgcaggcggcgggggcgcgtgcatggtgccttccacccgggcggagcttttgcgctcgacccaatactctccgctataaaggtcgcgttccgcgtgcttctctccatcacgctcctagaactcttcaaaccgatctctcgtcgatcttcaaccgccgcctccactcgccatggaccccaactgctcctgtgcctccggtaagggggactgctgacgggatttctgggagagctagacaggctttttggcccctcctttagtaattactttaagggtacgaccggctaccccttccgaatgaattctgaagcactcctgctcctttaaactagtccttgagatagtggctcgcctacccgggtgatttgcctcaccttcctaggagaacagcgttcaggtactcccgggtcccactcaaccgcgctcactgactgccttctacttttagatggatcctgctcctgcgctggcgcctgcaaatgcaaacaatgcaaatgtacttcctgcaagaaaagtaagttggatcttctctgccatttccccgtcactctcctggggtccctagcccgccgcgccgcgccttccctcccgggagcgttcaggtggtgtgcctctgacaaggtttctcgctcacgttcaactcttctctccccacaggctgctgctcctgctgccccgtgggctgtgcgaagtgctcccagggctgcatctgcaaagaggcttccgacaagtgcagctgctgtgcctgaaggggggcggaggggtccccacatctgtgtaaatagaccatgtagaagcctagccttttttgtacaaccctgactcgttctccataactttttctataaagcatgtaactgacaataaaagccgttgacttgattaattcagcttgtctctgtgcattggttaagggctgggctggcagaggcgttgagatgggactgcagcagctgaatttgagctagtcggattatatttctctggactttgaccgcctagaaagtggtcatgcagaagcatgcattggtcacagaaatgggccattcctactgggcgtgtgtgtgtgtgtgtgtgtgtgtgtgtgtgtgtgtgtgtgtgtgtgtgtattggggattaaaccgtaagctt

SEQ ID NO: 82 - DNA, 417 bp, Mus musculus
tttttttttttttttttagcgggacgctctggtttaatcacagcacgttcacaagctgtaaaaagttcactaaagcctccttgaagccacttgctgccgacctggcaggatctcacaagacaagctgccgctactccccggcctgtcagctcccagtgcactgaggggacaactatttcaggtcacataagaacaaggaccaattcagagaatgcacaaagatggctcacaaatataatgccggtagcagagttgcgtggggggcgtgaaatgtttacaggttactgtactgttgaagtaccgttttcagtgacaatcaagtgaatagggaacatttttaatcttttgacactgtaaatattgtagtcagagagtcagaagagaccgtatcacacaacgaaaccttctatcattgta

SEQ ID NO: 83 - DNA, 381 bp, Mus musculus
tttttttttttttttttccgtctcaaaatatttaattttgtttgaaaaggatacattcccaacttccctccataacacatcactccggcccaccagcagggacacactcgcacaggcacacacacacatgtaaggccaaagggctgctgtctgcttccacctctgcagctgggacaaagggcttttctcctggcctctttcccacggcaaaggtagggagaggggctgctggaatgcagctcccagggaggatgcagagcccacacactctaccaatcacatgcacttagaaaaataaaaccaagtggtgttctggcatccaacaccaaaagacagcaatctctacctggaaatcatcttttcctttttctagaaaatttt

SEQ ID NO: 84 - DNA, 2397 bp, Mus musculus
cgcctcaagttgaggatctaagccgccagccaaaatgtgtaagggactggcagctctgccgcactcatgcctggaaagggccaaggagatcaagatcaagttgggaattctcctccagaagccagactctgctgttgaccttgtcattccatacaatgagaagccagagaagcctgccaacggacacaagccctcactggaggaggtcctgcagtggcgccagtccctggacaagcttctccagaacagctatggatttgccacgttcaaaagtttcctgaagtctgaattcagtgaggaaaaccttgagttctgggttgcctgtgagaattacaagaagatcaagtcccccatcaaaatggcggagaaggcaaagcaaatttatgaagaattcatccagacagaggcccctaaagaggtgaacattgaccacttcactaaagacatcaccatgaagaacctggtggaaccgtctcctcgcagctttgacttggcccagaaaaggatctatgccctgatggagaaggattctctgccccgctttgtgcgctctgaattttataaggagctaatcaagtagtcatctggtcaggcttccaaaagttgaaatgtgagttgagttacatcctttgtagcaacacagcatcctcccaggcacctgcacagttctccatagcagctttgctccaagatacacaaacataggcaaaccacaggctgtgttgctaactctttcgctcatgttagtttggttatgtggatctgttgtctaagagccctcacttttttctttttcgttcgcctcaagttgaggatctaagccgccagccaaaatgtgtaagggactggcagctctgccgcactcatgcctggaaagggccaaggagatcaagatcaagttgggaattctcctccagaagccagactctgctgttgaccttgtcattccatacaatgagaagccagagaagcctgccaacggacacaagccctcactggaggaggtcctgcagtggcgccagtccctggacaagcttctccagaacagctatggatttgccacgttcaaaagtttcctgaagtctgaattcagtgaggaaaaccttgagttctgggttgcctgtgagaattacaagaagatcaagtcccccatcaaaatggcggagaaggcaaagcaaatttatgaagaattcatccagacagaggcccctaaagaggtgaacattgaccacttcactaaagacatcaccatgaagaacctggtggaaccgtctcctcgcagctttgacttggcccagaaaaggatctatgccctgatggagaaggattctctgccccgctttgtgcgctctgaattttataaggagctaatcaagtagtcatctggtcaggcttccaaaagttgaaatgtgagttgagttacatcctttgtagcaacacagcatcctcccaggcacctgcacagttctccatagcagctttgctccaagatacacaaacataggcaaaccacaggctgtgttgctaactctttcgctcatgttagtttggttatgtggatctgttgtctaagagccctcacttttttctttttcgttcgcctcaagttgaggatctaagccgccagccaaaatgtgtaagggactggcagctctgccgcactcatgcctggaaagggccaaggagatcaagatcaagttgggaattctcctccagaagccagactctgctgttgaccttgtcattccatacaatgagaagccagagaagcctgccaacggacacaagccctcactggaggaggtcctgcagtggcgccagtccctggacaagcttctccagaacagctatggatttgccacgttcaaaagtttcctgaagtctgaattcagtgaggaaaaccttgagttctgggttgcctgtgagaattacaagaagatcaagtcccccatcaaaatggcggagaaggcaaagcaaatttatgaagaattcatccagacagaggcccctaaagaggtgaacattgaccacttcactaaagacatcaccatgaagaacctggtggaaccgtctcctcgcagctttgacttggcccagaaaaggatctatgccctgatggagaaggattctctgccccgctttgtgcgctctgaattttataaggagctaatcaagtagtcatctggtcaggcttccaaaagttgaaatgtgagttgagttacatcctttgtagcaacacagcatcctcccaggcacctgcacagttctccatagcagctttgctccaagatacacaaacataggcaaaccacaggctgtgttgctaactctttcgctcatgttagtttggttatgtggatctgttgtctaagagccctcacttttttctttttcgtt

SEQ ID NO: 85 - DNA, 119 bp, Mus musculus
cgttgagagatctggtatgctattgtagatcaagaggctgcaaaggaagagaacgcatgaatgggacctgcagaaagggtcatttaatgtacacgctctgctgtcgctgaacatggaga

SEQ ID NO: 86 - DNA, 133 bp, Mus musculus
ttttgtgtctccagcgttgagagatctggtatgctattgtagaacaagaggttgcaaaagaagagaacgcatgaatgggacctgcagaaagggtcatttaatgtacacgctctgctgccgctgaacatggaga

SEQ ID NO: 87 - DNA, 133 bp, Mus musculus
ttttgtgtctccagcgttgagagatctggtatgctattgtagaaaaagaggctgcaaaagaagagaacgcatgaatgggacctgcagaaagggtcatttaatgtacacactctgctgtcgctgaacatggaga

SEQ ID NO: 88 - DNA, 133 bp, Mus musculus
ttttgtatctccagcgttgagagatctggtatgctattgtagatcaagaggctgcaaaggaagagaacgcatgaatggaacctgcagaaagggtcatttattgtacacgctctgctgtcgctgaacatggaga

SEQ ID NO: 89 - DNA, 928 bp, Mus musculus
tataaatgcaagttggctactcactctccacacattgggctcctgctcaccaattctccaggtgacccccagccatgaagacatttgtcctcctctctgcccttgtcctgctggccttccaggtccaggctgatcctatccacaaaacagatgaagagactaatactgaggagcagccaggggaagaggaccaggctgtgtctatctcctttggaggccaagaagggtctgctcttcatgaagaatgtgagtagtggtacgcagtgtgatggatgcttgcagtctcctgagggagggatgaagatgagctctagaatactggtagagtaatgtggctcccttggcaactctattttgattccttttatattcataacagtagtaatgagaggaaagtaattttaattgaattattttctcataaggcttttaatgtaaaaagatacacatgggaatttcaacaataagagtgctccaatactctgagtagatacttctagatcaggactagacttgggttttagtaaaaaattttctttctgtaaaggaactttgaatcaatttatgagtataccctagtgtctacactgtgacaaaaggaacacagaaaataaagacacatcagaatggctctcaagtacatgaccaacacccatgaagtgtgttattggttgagatgtccatgctgaaggctgtactgtgtcgaacacagcacattcatgctgtatcacatatccccataggatcacatactattacatgctgccaaccgcaaaacttattgccggattctttttgtgtctccagagtgtcaaaaaagctgatatgctattgtagaataagaggctgcaaaagaagagaacgcgtttttgggacctgcagaaatctttttttaactttcgtattctgctgtagctgaatatgcaga

SEQ ID NO: 90 - DNA, 470 bp, Mus musculus
tgaatcttccaggtgactcccagccatgaagacactagtcctcctctctgccctcgtcctgccttgcttccaggtccaggctgatcctatccaaaacacagatgaagagactaaaactgaggagcagccagaggaagaggaccaggctgtttctgtctcctttggaggcacagaaggctctgctcttcaagatgtagcccaaagaaggtttccgtggtgccggaagtgccgagtgtgccagaagtgccaagtgtgccagaagtgccctgtgtgcccgacatgcccccagtgcccaaagcagccattgtgcgaagaaaggcaaaataaaactgcaatcaccacccaagctccaaatacacagcataaaggctgttgagctgaatgtggaatctgggttgagatgaccatttgcttttggtcctcacgatcccgttgtgcttagcgtcaattgcaattccttctctcataaa

SEQ ID NO: 91 - DNA, 133 bp, Mus musculus
ttttgtgtctccagcattgagagatctggtatgctattgtagagcaagaggctgcaaaggaagagaacgcatgaatgggacctgcagaaagggtcatttattgtacatgctctgctgtcgctgaacatggaga

SEQ ID NO: 92 - DNA, 926 bp, Mus musculus
acttgagggtaacagcctctcccaattccacacattgagctcctgctcaccaatcctccaggtgactcccagccatgaagacactagtcctcctctctgcccttgccctgctggccttccaagtccaggctgatcctatccaaaacacagatgaagagactaaaactgaggagcagccagggaaagaagaccaagctgtttctgtctcctttggagacccagaaggctcttctcttcaagaggaatgtgagtactggtgcccagtgtgatggatgcttgcattctcctgagggagggatgaagatgagccctagaatcctggtagagtaattttgctcctctggcaacactaatttaattccttttatattcataacagtaacagcgagagaaaagtaactctaattgaatatctttctcataaggcgtttactgtaaaaagatatacatgggaatttcaatactcacagtactccaatactctgattaaatgcttatagaacaggattagtcttgggtattagtagaaatctttctttgtgtaaaggaaaattgaatcaatttcaaagtatacaaaagtgtctacatggtgacaaaaggaacacagaaattaaagacacctcagaatggctctcaagtgcatgaccaacacccctgaagtgtgttattggttgagatgtccttgctgaagtctgtattgtggccaacacagcacattcatgctgtatcacatatctccataggatcacatattattacatgctgccaacctcaaatcttaatgcctgattctttttgtgtctccagcgttgagagatctgatatgatattgtagaacaagaggctgcaaaagaagagaacgcctgaatgggacctacagaaagggtcatttattgtacatgctctgctgctgctgaacatggaga

SEQ ID NO: 93 - DNA, 268 bp, Mus musculus
ctgcagcagtctgacgctgagttggtgaaacctggggcttcagtgaagatatcctgcaaggcttctggctacaccttcactgaccatgctattcactgggtgaagcagaagcctgaacagggcctggaatggattggatatatttctcccggaaatggtgatattaagtacaatgagaagttcaagggcaaggccacactgactgcagacaaatcctccagcactgcctacatgcagctcaacagcctgacatctgaggattctgcag

SEQ ID NO: 94 - DNA, 1865 bp, Mus musculus
ggtcaggcagagactctctctcggcttttttccctcctgcctaaggatctccaacggagagctgcaacaatgcccaaaagaaaggctgcaggtgatgtgagccaggagccaaagagaagatcagcccgactgtctgctatgcctgtgccctttacaccggagttgaaacctaaaagagcatcaacttcaaggaaaaccaagaccacaaatgtcgtggaagaaaacaaagatgcaagtaccataccaattcctgaaaccaagccagaagatgttaaagacgaatgcaacatggaaaatgctgaaaatggagaagccaagattatggaggcacccattcctaaaatggaagctgaggaagtaaaagaacagataaatgaagacactgaagaagatggaggagaaaagaaagaagcagttgcagcagaagccaaagatgatgagctaaaagcaaacattcaagatgtggagaaagatgaagatggaaaagagcacaaagatacaggtgaggaggtggaagacggaaaaatagaagaagaaggcctaaacgagaaaccaggtacagccaaaagtgaagatgcagaggtgtccaaagatgaagaagagaaaggagacaatgaaaaaggagaagatggcaaagaagaaggtgatgagaaggaagaagagaaagatgacaaagagggggacactggaacagagaaagaagtaaaagaacaaaacaaggaagccgaggaggatgatgggaaatgcaaagaggaggaaaacaaggaagttggaaaggaaggtcagcctgaggaagacggaaaggaagatctgcatgaggaagttggaaaggaagatctgcatgaggaagatggaaaggaaggtcagcctgaggaagatgggaaggaaattcatcatgaggaagatggaaaggaaggtcagcctgaagaagatggaaaggaatatctgcatgaggaagatggagaggaaggtcagcctaaggaagatcaaaaggaaggtcagcctgaggaagatggaaaggaagatcagcctgaggaagatggaaaggaaggtcagtgtaaggaagatgggaaggaaggtcatcatgaggaaggtggaaaggaagatctgcatgaggaagatggaaaggagaaagatggtggaaaagaggatagaaaggaagaaggagagcaagaggttgctgtagatgaagggagtgatgaaaacaaggtggaggcagaagaagaaggagccgaacacaaagacttcaaacaagatggagagaaagaggagcctctgagtattgtctaaaactgccctctgtgagatcataattcggtaacacgtaccttcctgttgtaatgttaatagagataaatatttttatcagatattttataaacagtgcttttctttagcatcattcaatcttagatcatcatcatcatacaggttattagttgcaaaatgcctaacatgacacctttatacattttgtgattatagtagtgcaaaaatataaaatgtatacttgcaactttgtgaatttcatcatgtgtaagttatgtattaaatctttgagtttcaattttattcttatacgtggtaaatttgcagagtaggagaattccaaaagaaagagtttggcacaactttgatgtaggtctctaggttgcttttataaagaaggtcaactattttcaggtaatgctaagagtcggaattgacattaccaaatacaactgtattagtagcttggaaagtataaaattttaatttcatttttgaagaaatttgaatgtttatttcaggagggcagttttgattatatgtgtatgcacaaagttttgctggatttatcataataaaagagttccacaaatatg

SEQ ID NO: 95 - DNA, 1725 bp, Mus musculus
gtgcctggccacgcggtattgccaggaggctgggaggtgagggggaggtccaacacaatccaactgacaaggatggactacgccatgaagtctctcagcctcctgtaccccaggtcgctgtccaggcatgtggcagtgagcacggcagtggtgacccaacagctggtgtctaagcccagccgggagaccccgagggccaggccctgtcgtgttagcaccgcagatcggaaggttcgcaaaggcatcatggctcacagcttggaggacctcctgaacaaggtccaggacatcttgaaacttaaagacaagcccttctccctggtgctggaggaagatggcacaatcgtggagacagaagaatacttccaagccctggcaaaagataccatgttcatggtcctgctgaaggggcagaagtggaagcccccatcagaacagcgcaagaagagagcccagctagccctttcccagaagccaactaagaagatcgatgtggcccgggtaaccttcgacctgtacaagctgaaccctcaggactttattggctgcctgaacgtgaaggcaaccctctatgacacatactcgctttcctatgacctgcactgctacaaggccaagcgcatcgtgaaggagatcgtccgctggaccctcttcagcatgcaggccaccggtcacatgctgcttggcacctccagctacatgcagcagttcctggatgccaccgaggaagaacagcctgccaaggccaagccctcctccctcctcccagcctgtctgaagatgctgcaatgaagacccgagtcctcagaggccttccttgggccatggatgtgaccggggaccctgcgctcggctagcagcacccatgagcctggcagccagacagcttctcacctgcctgcgcctccctcacagcacagcaccaaggaaattgcaggaagggctggagccctggggtgggctggtcacaggaggacttcctagcctggcccagttccttcctttctgtctcaggtagcttagaggactaacacttagccctggcaggcacaaagtctgcccctgtgtccacttgtgccgtcttccgtgccactccctctctggtgcaccccaccatccccggtcctggctgcccacactcatcatgcagtagacattattatggtggcccccatcataccttggcctgaatcaagacaaccaagcgagcagcatgccacagcaccaactatgtctatgaccatggtgccagagtggttagcactctgtagtagaagaaaaggaggtgggggcttcgggggtctctcacctgggactctgatcactccctcctagcccccagctgcacatgatcatgaggtgtgcgagagagtgttagaggtggagattaactaaagccggcatgccagggatgcagatctggggggtcctcacctgtgccagggatgcagatctggggggtcctcacctgtgccagggagggaccttagggaatgcagatgattctgagtcacccaggcccctcctgtaagtaacctaaaagctcatagattcaccaagctggacttgggtgaaaccgcggcttagcctctcattgcctgaatggacacagttcctgttctcctgggaaaggcatgcagctgcctctcttgttctcatttttccacgaatgagtgaatggtattagagtctgcagtaaactatttatgctgaaaaaaaaaaaaa

SEQ ID NO: 96 - DNA, 783 bp, Mus musculus
atggcccaggtcaaactgcagcagtctggggctgaactggcaaaacctggggcctcagtgaagatgtcctgcaaggcttctggctacacctttactaactactggatgcactggataaaacagaggcctggacagggtctggaatggattggatacattaatcctagcactggttatactgcgtacaatcagaagttcaaggacaaggccacattgactgcagacaaatcctccagcacagcctacatgcaactgagcagcctgacatctgaggactctgcagtctattattactgtgcaaaatcagggggtgactactttgactactggggccaaggcaccacggtcaccgtctcctcaggtggaggcggttcaggcggaggtggctctggcggtggcggatcggacatcgagctcactcagtctccagcctccctatctgtatctgtgggagaaactgtcaccatcacatgtcgagcaagtgagaatatttacagtaatttagcatggtatcagcagaaacagggaaaatctcctcagctcctggtctatgctgcaacaaacttagcagatggtgtgccatcaaggttcagtggcagtggatcgggcacacagtattccctcaagatcaacagcctgcagtctgaagattttgggagttattactgtcaacatttttggggtactccgacgttcggtggagggaccaagctggagctgaaacgggcggccgcaggtgcgccggtgccgtatccggatccgctggaaccgcgtcccgcatag

SEQ ID NO: 97 - DNA, 2267 bp, Mus musculus
gaattccgccgacaaccccagacgccaccgcctggagcgtccagacaccaacctccgcccctgtccgaatccaggctccagccgcgcctctcgtcgcctctgcaccctgctgtgcatcctcctaccgcgtcccgatcatgctcgcctccgtcgcaggtcccatcagcctcgccttggtgctcctcgccctctgcacccggcctgctacgggccaggactgcagcgcgcaatgtcagtgcgcagccgaagcagcgccgcactgccccgccggcgtgagcctggtgctggacggctgcggctgctgccgcgtctgcgccaagcagctgggagaactgtgtacggagcgtgacccctgcgacccacacaagggcctcttctgcgatttcggctcccccgccaaccgcaagattggagtgtgcactgccaaagatggtgcaccctgtgtcttcggtgggtcggtgtaccgcagcggtgagtccttccaaagcagctgcaaataccaatgcacttgcctggatggggccgtgggctgcgtgcccctatgcagcatggacgtgcgcctgcccagccctgactgccccttcccgagaagggtcaagctgcctgggaaatgctgcaaggagtgggtgtgtgacgagcccaaggaccgcacagcagttggccctgccctagctgcctaccgactggaagacacatttggcccagacccaactatgatgcgagccaactgcctggtccagaccacagagtggagcgcctgttctaagacctgtggaatgggcatctccacccgagttaccaatgacaataccttctgcagactggagaagcagagccgcctctgcatggtcaggccctgcgaagctgacctggaggaaaacattaagaagggcaaaaagtgcatccggacacctaaaatcgccaagcctgtcaagtttgagctttctggctgcaccagtgtgaagacatacagggctaagttctgcggggtgtgcacagacggccgctgctgcacaccgcacagaaccaccactctgccagtggagttcaaatgccccgatggcgagatcatgaaaaagaatatgatgttcatcaagacctgtgcctgccattacaactgtcctggggacaatgacatctttgagtccctgtactacaggaagatgtacggagacatggcgtaaagccaggaagtaagggacacgaactcattagactataacttgaactgagttgcatctcattttcttctgtaaaaacaattacagtagcacattaatttaaatctgtgtttttaactaccgtgggaggaactatcccaccaaagtgagaacgttatgtcatggccatacaagtagtctgtcaacctcagacactggtttcgagacagtttacacttgacagttgttcattagcgcacagtgccagaacgcacactgaggtgagtctcctggaacagtggagatgccaggagaaagaaagacaggtactagctgaggttattttaaaagcagcagtgtgcctactttttggagtgtaaccggggagggaaattatagcatgcttgcagacagacctgctctagcgagagctgagcatgtgtcctccactagatgaggctgagtccagctgttctttaagaacagcagtttcagcctctgaccattctgattccagtgacacttgtcaggagtcagagccttgtctgttagactggacagcttgtggcaagtaagtttgcctgtaacaagccagatttttattgatattgtaaatattgtggatatatatatatatatatatatttgtacagttatctaagttaatttaaagtcatttgtttttgttttaagtgcttttgggattttaaactgatagcctcaaactccaaacaccataggtaggacacgaagcttatctgtgattcaaaacaaaggagatactgcagtgggaattgtgacctgagtgactctctgtcagaacaaacaaatgctgtgcaggtgataaagctatgtattggaagtcagatttctagtaggaaatgtggtcaaatccctgttggtgaacaaatggcctttattaagaaatggctggctcagggtaaggtccgattcctaccaggaagtgcttgctgcttctttgattatgactggtttggggtggggggcagtttatttgttgagagtgtgaccaaaagttacatgtttgcacctttctagttgaaaataaagtatatatatattttttatatgaaaaaaaaggaattc

SEQ ID NO: 98 - DNA, 374 bp, Mus musculus
gtagttccagatatgctggaatgttagcccttgctaggagaaagctggttgtgcctatgtaatataggacaaaggtgaccgatttcatcaagtttggagtcaattctaacaataaaaatatgtataatttgtcaccggcatccccattattgctaattcattacagtatatacacatccatgcatacatatgtcaatgatgctttagctttcaatttatttattagctgtaaataatgtgtgggtatgtaagaatgcttgtaaacactggaaagtctgttgtggttatctgcagtatagatttgtgggtgcaactttgtgtccgtctccatccatgattgtctgtctcactgagccaacttaactctgatgaaa

SEQ ID NO: 99 - DNA, 475 bp, Mus musculus
tttttttttttttttttaagcggaaaaaacatttatttctatcaaattcaatacaaatcaatcttcaagcaaggtaacaaaacaaaacaaaaatcaatgaatacaatgaatagttaggatagcagatacagaacagactctgaactaagcacatatacccaaatcaagaggaacaccaactgtcactgaagaaaagctgacgtgccagctccagggaaacttaagccaacactgagttaaagactggcttgaacttgggggatcacagtgaaatgccatcctagctcaacgtcgtcccccagagatcggtccagctcaaaaaaacaaaattcgcaaattcagtagtacaagttctcataagactagagaagccttgagctctaccatttcttgcagtccacacagagcctggggttttcaatttttcttcccttttcccaaatcccagagagaaggtgcggtactccctgcaaag

SEQ ID NO: 100 - DNA, 4701 bp, Mus musculus
cgggtcgacccacgcgtccgcccacgcgtccggcggagcttctgggttgcgggccgaaacggcaagcggatggagggcgctcgaacggccaggtgtcgtgattaaattagtcagccctcagagacaggcgtcctacctcctttatccagacctcaaaagccccgttgtgcacccgtggtggcttcttcaccttccctgtttcgtcctccactgtatggcccagacatgagtggtcccctagaaggggccgatgggggaggagaccccaggcccggagaacctttttgtcctggaggagtcccatcccctggggccccgcagcaccggccttgtccaggccccagcctggctgatgacactgatgcaaacagcaatggctcaagtggcaatgagtccaacggacccgagtccaggggcgcatctcagcggagttctcatagttcctcttctggcaatggcaaggactcagctctgctggagaccactgagagcagcaagagtacaaactcacagagcccatccccacccagcagctccattgcctacagcctcctgagtgcgagctcagagcaggacaacccatctaccagtggctgcagcagtgaacagtcagctcgagccaggacccagaaagaactcatgactgcacttcgggagctcaaacttcgactgccaccagagcgtcggggcaagggccgctctgggaccttggccacactgcagtacgctctggcctgtgtcaagcaggttcaggctaaccaggaatattaccagcagtggagtctggaggagggtgagccttgtgccatggacatgtctacttacaccctggaggaattggagcatatcacatccgaatacacacttcgaaaccaggacaccttctctgtggctgtgtccttcctgacaggccggattgtctatatttcggagcaggcaggtgtcctgctgcgttgcaaacgggatgtgtttcggggtgcccgcttctcagagctcctggctccccaggatgtgggtgtcttctatggctctactacaccatctcgactgcccacctggggcactggcacctctgcaggttcaggtctcaaggacttcacccaggaaaagtctgtcttctgccgaatcagaggaggtcctgaccgggatccagggcctcggtaccagccattccgcctaaccccatatgtgaccaagattcgggtctcagatggagcccctgcacagccgtgctgcctactcattgccgagcgcatccactctggttatgaagctccccggatccctcctgacaagaggatcttcaccacccgacacacaccaagctgcctcttccaggatgtagatgaaagggctgccccactgctgggttaccttccccaggatctcctgggggctccagtacttctctttctacatcctgaggaccgacccctcatgctggccattcataagaagatactgcagctggcaggccagccctttgaccattcccctattcgcttctgtgctcggaacggggaatatgtcaccatggacaccagctgggccggttttgtgcacccctggagccgcaaggtggctttcgtgttgggtcgccataaagtgcgcacggcacccctgaatgaggacgtcttcactcccccagcccccagcccagctccgtccctggactctgatatccaggagctctcagagcagatccatcgattgctgctgcagcctgtgcacagctccagccccacggggctctgtggagttggccctctgatgtcccctggtcctctacacagccctggctcctccagtgatagcaatgggggggacgctgaggggcctgggcctcctgctccagtgactttccagcagatctgtaaggatgtgcatctggtaaagcaccagggacaacagctcttcattgaatctcgggccaagcccccaccccggccccgcctccttgctacaggtacattcaaagccaaagtccttccctgccagtccccaaaccccgaactggaggtggccccagttcctgaccaagcctcgttagccttggcccctgaggagccagagaggaaagaaacctctggctgttcctaccagcagatcaactgcctggacagcatcctcaggtatttggagagctgcaacattcccagtacaaccaagcgtaaatgtgcctcctcctcctcctacactgcctcttcagcctctgatgatgacaagcagagggcaggtccagttcctgtgggggccaagaaagatccgtcgtcagcaatgctgtctggggagggggcaactcctcggaaggagccagtggtgggaggcaccctgagcccgctcgccctggccaataaggcagagagcgtggtgtccgtcaccagtcagtgtagcttcagctccaccatcgtccatgtgggagacaagaagcccccggagtcggacatcatcatgatggaagacctgcctggcctggcccctggcccagcccccagtccggcccccagccccacagtagcccctgacccaaccccagatgcttatcgcccagtgggtctgaccaaggccgtgctgtccctgcacacacagaaggaagagcaagccttcctcaaccgcttcagagatcttggcaggcttcgtggacttgacacctcttctgtggccccctcagcccctggctgccaccatggccccattccccctggtcgccgacaccactgccgatctaaagcaaagcgttcccgccaccaccaccaccagaccccccggcccgaaactccctgctatgtctcccatccttcacctgtgccctcttctggaccctggccacccccaccagccacgacccccttcccagcaatggtccagccctacccactcccagtattctcccctcgaggaggaccccagccccttccccctgcccctacatctgtgtcccctgctaccttcccttctcccttagtgaccccaatggtggccttggtgctccctaactatctattccctaccccacctagttatccatatggggtgtcccaggcccctgttgaggggccacccacgcctgcttcccactcgccctctccatccctgcccccaccacctctcagccccccccaccgcccagactccccactgttcaactcgagatgcagctccccactccagctcaatctgctgcagcttgaggagtccccccgcacggaggggggcgctgctgcaggaggcccaggaagcagtgctgggcccctgcctcccagtgaggagactgctgagccagaggccagattggtggaggttactgagtcgtccaatcaggatgcactttcaggctccagcgacctgctggagctactgctccaagaagactctcgctcgggcacaggctccgcagcctcaggctccctgggctctggcctgggctctgggtctggttcaggatcccacgaagggggaagcacctcagccagcatcacccgcagcagtcagagcagccatacaagcaagtactttggcagcatcgactcttccgaggctgaagctggggctgctcgggccaggactgagcctggggaccaggtcattaagtgtgtgctccaggaccccatctggctgctcatggccaatgccgaccagcgtgtcatgatgacataccaggtgccgtccagggatgcagcctctgtgctgaagcaagaccgggagaggctccgggccatgcagaaacagcagccacggttctcagaggaccagaggcgggaactgggtgctgtgcactcctgggtccggaagggccagctgcctcgggcccttgatgtgatggcgtgtgtggactgtggcagcagcgttcaagatcctggccactctgatgacccgctcttctcagaactggatggattggggctggagcccatggaagagggtggaggcgagggtggtgggtgtggtgttggcggtggtgggggtgatggtggtgaggaggcccagacccaaattggggctaagggttcaagctctcaggactctgccatggaggaagaagagcaaggtgggggctcatccagcccagctttacctgcagaagaaaacagcaccagctagatccattttggggccgcttacagcagtctaatgagaggcttcctttcgaccatgttggggttcttataactcaagatacagctggaccaaccaataggaaactgccccagcttctcccaacatagggggctggacccccattaccagcccaggcacaggagctgcctctagcttcttagcagagtggaagttctcagccccatttggaggattgtccacgcccgtcccactgaggagacgggcgggtcttcggttaaggttgctgacaagctgctgaagtggtctgtccaaatcccagctgagcctgagtcccagtcgcagggttggggctgcacttatttatttgggagagacagctcactctcccacctcaccccaagatgggaggaggggaacctgggatctgtgtaggatccaggtccgtgaacccctagctgctccagggtgggggaggttggtggaccatggagtccctggtgctgcccctcaggtgggacccaggtgttctcagctctaccctctaccaatgacatttgtgtttttgatattgtgtctgttattttttttttaatacaaaatgacaaaatgaaaaaccaaaaa

SEQ ID NO: 101 - DNA, 11478 bp, Mus musculus
ggatccaatatgatatggttatattcaattataatttgtataagcatcacacatggattaggtgttgattccacagaaacaccaaatcctgcaagctgtccctgctgctggtgcactcaaacttctgttcactccagttagcaagtaatttccaacactatcatatgccaggcaatgctttaggtaccaagaataaagcagacaacagtctgtgctgtctggggaaggggcaaatgaacaataaatggccaagaaaagtactaggcagctgatatctgagagtgtaactaaccttgggtgcaagcagaggtctcttagtggcactgtacaccagagggctgaggatagcccatacagatagattggattgacaaaggaagccatgtcacccaagtcatttcacactcacagctcatcttcttgtctcctcccgaatgcctttagcttgctctgcttggaaatatctagagtcttcctcacaccaccttcctacctctctacccaagagtctcccttggttccataatatacagtacaaggtgtgaccggtctcgctataaagacaatgcccccacaccacaactcgggttcgccatctcctgccctgacaagagcgcactggtgtgtagctgtggctgccctccaccgcgttgggaaggccgtagtaagtaagcatcacacagtgactatttctacttatctccaaaggcccgagttcagataaaaaaacttggggactcaacacatcccactcgcattaaaatctcccgaggttgaagtcaggtatgatggcatatgactttaatcacagcactagggaggcagggggatctctgagttcaaggccagcctggactacagcgtgagtcccagggcagccaggaatacacagagaaaacctgtctcataaaataacatctcctaggtcgggccaggcgtgccgatacaggtcgaggctaacatggtctacatgtgtgctctaggacagtaaagaataaagtcctatctcaactccggacgaaaactccacaggtgatttctagtggatgttgttagctgatgaagggcgcctgtgtgctatgcttggaaccagttggttgcaatccatttaaagcaacgccagacaactctctcgttccccccgccatggagggaacctgtgagcgtggtcacaggcgggccgagtacttctccccaccacaccaggaagtcacctctctcaacctggagttatacctaccgcgagaggtcaccgacattacatggatcgcttgtgcactgctcgtacacacacacacgcacaactgcttttattaggagctctcaggaaagcggggactcgcatcatagccaagaagccgttcgcgactccgcggagaacaggccgaggcccgctcatcagcccgagggaaccctaggccttccggcgttcttcagcaggaccacgcggcggggggaaagcaccgagaaacgcccagaccacctgagcatcgccgcccatgctgcctcggaacacctgagggaatccgggccacgccgccacctacccgcgcctcacacacaagccgcgccaaactcgcccgtcccactgcgcaggcgtggggagagcccggcgctcaggagcattcaaaggacccgcacactgaccagtcaacgtccgcctgggcccaaacgagtcccgccctcaggagcagacgtcaggccccgcccctaagagccccgccctcgtcaagccttaggcccgcctcacgctgccccgcgttaaggctcgcggttggctccggggacggacgcgagctctggttggtggagccgaagtcacgaggacccccttcgtcgcctttccagaggcgattactgggcaggctcagtcttttgcctcagacgctagctgtagctggcaggcggttgtacgtgctccagagtcgtcggtacccgctactgcagtcgctttcgtgtggcttccgctgagctcttccgagctgctcgctctccacacgcgccgccgccgtaatccgccaccatggtgaagctcgcaaaggtaagaggccttggcgcgccgacgcggacgactaggcccctgctttcggagggacgcgcgcgcgcccgcccgtccgtcgcggaggggaggagggcttgcgcgcaatcccgggcgcgttcgagggcgccatgctgggggggaaagtctcgcgcgactagcgggaggtctcgcggtgcttgccctctgacttagggggatgagaagagcggaggcaggtttccgggagggcgatatcgagggttcggatgtagcgggcgggaggggacggtgtgaggagagatcggaggagctgagagcggataggggcacggcgtgggaagagagggccaaccttaggcggcgagcggtcccggggccccgcctccccgcgcacgtgctctggtgcgcgcccgccacgtgctctgcggagccccgcacgtgtcgcgcgacccggggcagtgggggagtgtctgtagtaccccggaaagggggacggcagcgtggggatggatgggtggcccggcgatctgctgtctctgccggtgaccgggatggacacgtggtggacccctgaggtggcggcgtggtgactccacgtggtggggctggaagcgagagaaagtgggaagcagttgggttacgtggtgctgctttaagaggtgatttcgagatacccccttccccagcaaataacttaaagggatccctttaactgggtttttttttttttttttttttttttttttgtggaagatgccagaaaatagatggccaggattaggagactttataacctgtggctgtttcttggtgtagagttctgtctgctcagttatctgtgagaaggaaaaaaaaattatgcgcggttcgcagaaaaaactgccaggagaatgccatgcctggccaagaagaagtctttatgcttgtgtcctttagtaagaaaaaggtggtggccaaaggcaaagtgactgaaaatgcgtgcaatttttgtgtgcgtttgtaggctggcaaaacccacggtgaggccaagaaaatggctcctcctccaaaggaggtggaagaggatagtgaagatgaagaaatgtcagaagatgaagatgacagcagtggagaagaggaggtaagaagctatttgcagcgaattaaaccggtggaattgaatgtctggaagtcttagaaatacaggatatgtagtaaatggttgaatggcaagccccttcctccctccctccctccctccctccctccctccctccctcccttccttccttccttccttccttccttccttccttctgcaagacagtcggcaaaacaggggacagaaacaggcagaattttgagttccaggcaagcagggagtagtacatagtgaaaccttgtctcaagaccgttgttatggtcatgctcaatcagatttcttagaaaagctcaggtgctgagtccagtttttttttttttaaagtattgaaagccatgtctccttatttcagggtttaatgtttatctttgtgtgtgcgcgcacccattaagcatgcttggtaccctcatactagaatgtacttggatcccctggaactggagttaaagccacatgtgaatgttacatgttacaagagtaacacatgtgcttaacttttgagtcatctctccagttcttggttgtttgtttttttttttttaagcctatctaatgtccattttcttgtgctcaaagttagtctcttaatgtagcattgggtataaaggaatgcttatgatttgtttgctttcaaggttgtcatccctcagaaaaaaggcaaaaaggctaccacaaccccagcaaagaaggtggttgtttcacaaacaaaaaaggctgcagttcccacaccagctaagaaagcagctgtgaccccaggcaaaaaggcagtagccacaccagctaagaaaaacattacaccagccaaagtcattccaacaccgggtaagaagggagctgcacaagcaaaagcgttggtaccaactcctggtaaaaagggagctgccactccagctaagggggctaagaacggtaagaatgccaagaaggaagacagtgatgaggatgaagatgaagaggatgaagatgatagcgatgaggatgaagatgatgaggaagaggatgagtttgagccaccaatagtaaaaggagtgaagccagcaaaagcagctcctgctgctcctgcctcagaggatgaggaagatgatgaggatgaagatgatgaggaagatgatgatgaagaggaggaagatggtgagttagatcttaggatatttagggtactgcatgtacattccctcactgtttcattagattaaaaactcattttgtgctcttagttctttccataacttaataggttttcatttgctaagtagtttttgttttttttaagtatttgtagcatttatcttgtctggattggtaggtagcaaatacatttgcctgatttgccatctttcttccagactctgaggaagaagttatggagatcacaacagccaaaggaaagaaaactcctgcaaaagttgttcctatgaaagccaagagtgtggctgaggaggaggatgatgaggaagaggatgaagatgacgaggatgaggatgatgaggaagaggatgacgaagatgatgatgaggaagaagaggaggaaggtaaccatattaacttttaaagtatgctgacctaagtaaggcttactggctatgctaaagtgtctgcttactcatgaatggcattttaaaacatctagaacctgttaaagcagcacctggaaaacggaagaaggagatgaccaagcagaaagaagcccctgaagccaagaaacagaaagtagaaggtaagcctgcaaaactggggaaacagatcagagtagcactagcacaagtgatgagtgacaaagggacttaatactgaaccatggggttgaaatgaaatatgctgatgtgctttatagtttatgatgaaatttgttgtgtgcttaagtgggctgaaagttcattttttgtgtgtgcaggctcagaaccaactacacctttcaatctgttcattggaaaccttaatccaaacaagtctgttaatgaattaaaatttgccatcagtgaactttttgctaaaaatgatcttgctgttgtggatgtcagaactggtacaaataggtaagttttaattgaatgttacatgtgtatcagctagaatttttagtttccagttgtattcttccctgcctttaaacatggggctatatctaactatgttagtaaaagtcagttgtctcctctcgtggccttaagtacagttaaggagctgcagtaagaaagactatagtattgaactaaatgatcgagtcatagggcctgcaatttgaagttcctgtgtttgacttgataaagataaaataaaatttaaagaagaaaagatattaaacacataaaattttgtgcagtatctacaactatggatctgcatagtcatatgcttttagctaaaagtattctctgtacttttagcggggtccatgctagctactgctgttagttacaatatactgaatgaagaaatcgaggtgaatttgttgtaatgtcttggtacatggacttgttttgttttttgtttttttttctttaagatttgtttatgtatatgagcacactgtagctgtccagatggttttgagccttcatgtggttgttgggaattgaatttttaggatctcagctcgctctgctctcagtccttgcttgctctggcccaaagatttatttgttgttatacataagtacactgtagctgacttaagatgcatcagaagagggcattaggtctcattatgggtggtggtgagccaccatgtggttgctgggatttgaactcaggaccttcagaagagcagtcaatgtgcttacccgctgagccatctctccagcctttggacttggttttatggaagataagggtgatctagttttatttttgttagtgctgtagatgctctgtgtgtgtgccacatggtataagtgcagatcaccttctcatacctgtaatcttgttttttccatcttcaaggaaatttggttatgtggactttgagtctgctgaagacctagaaaaggccttggagctcactggtttaaaagtgtttggcaatgaaattaaactagaaaaaccaaaaggaagagatagtaagaaaggtatgtaagggggtctgggtgactggatactaacagacttaggcagtctggtgcctcttccttagtttcatcctcattgtgaaccaatgagatgtcataggtcatgtgcttgttgacaggtttgattcctgggatatataatgtcagggctgacaggaggaatagcttagtgagtaaagatgcttgctgcaaaatgtttgatctctagaagccacatgaagagagaagaacctttaatcccagcatttgggagacagaggcaggcagatttcagagttcgaggccagcctggtctacagagtgagttccaggacatccagggctacacagagaaaccctgtctcggaaaaaaagttttagcttatcctctgaccacatgtgtatcgtgacatgcttgaagcttacctatctcttaaatgaattcttgatccctatattttgagtttcagaatttggattttaagtgtttgtttcttagttgtgctgaaaattgaacgtgggcttttcacatgctaggcaaatttgttgggtttttttgtttgtttttttctcaagacagggtttttctgtgtagccctggctgtcctggagaccaagctagccttgaactcagaaatctgcctgcctcccaagtgctgggattaaaggcgtgagtcaccactgccctgctaggcaatcactcttaaaactgctacatatcctctgtccccttttgctcattttacaaggttgctgtgtgctcaatctgcagtctatgttatatgcttactggatctaggcttttgatgtagaatgaaccatatgagtgatgaggtatcttagagatggaaactaagtctaaatagacttgttccatatacaacttaatacatatggtctaaggaacatgatatacatgtaaacaagtaggaaggagataagtctggtgtccagggaagccaggagagcctcatctgaaactggacaggggtttgtgagtcatcaggtgacaattgaacatgggtactcttcatgcaaatggttagtaaccattgagccacctctccatccctttataccatttttttttttagcatatatccttgtactttataggaattatttgctttattctcttgtgacttgtaaattgatgtacttaattaaatctttttccaacatagttcgagctgcaagaacacttctagccaaaaacctctctttcaacatcactgaggatgaattaaaggaagtgtttgaagacgccatggagatcagattagtcagccaggatgggaaaagtaaagggtagttttgtgtctttgagtgttaaagttttattaagtttagtgtcttcttcccctctccttgtccttgacagtctctagtctgctgcttcaaacttaacttcataaccagaaaattgaatatctggtcctctggcctctacctcccaagttctgacattaaaaatgctcaactgatgggttttgaaggtgtgatcaattttacaggctcaatccaaattggcatcttttgccacaagtactatccttccctattttatgagagaaatgtgattctaggcagttcagtctattgtgttggctctttttcctcctcaccagtttaaaggatgaagatgagctaatacatagtaaaagaacagtaaaagcacatgtgactaagtccttcatgtctgatgcttgagtaatattttctctaacgtagtaactgaattgtcttgtactctttcaggattgcttatattgaatttaagtctgaagctgatgcagagaaaaatttggaagaaaagcagggggcagaaattgatggacgatctgtttcactctactatactggagagaaaggtcaaaggcaagagagaactggaaagaccagcacttggagtggtaagttaaagggtttattgtgtagtgggaacaggaatcatttgtatctttgtattttaagtaattggttacctacaattagttcacctttgttcatatagctgatgtttagtcttcatgagtgaaagctatttgaaatcatttcctttggagtatagtaggcaaataaagctttttgttgggtatgttttgtactttaaatggcttaaactattttagaaaatagtgtaagacaacaaagaacagttatctaattagaatgaaaatgaaaggagcaaagaaggcattactgtatataatggatatacactggtggttctagaattatggtatatggtacatggttgaagtgccattgtttcagttaacattccagtaaccttgtggattaggttggagacatgctttataggtgacccacttactgagtgtttaaatatacacagacatactctaacataccttgctaatgtgttatctttgtatttgcaggtgaatcaaagactttggttttaagtaacctttcctacagtgcaacaaaagaaactcttgaggaagtatttgagaaagcaacttttatcaaagtgccccagaacccacatggcaaacctaaagggtaaaataatttttacgttagatgtgggctggacatacatactcttacgtataagagtaagactgtcctgttagcttaaaaaaaaactaaagttttagctatacaaagggcagtaaatattgatagtaaattacatgctgatgccaagtgtttctaagctttattctgagaactgactttcaaccttcaggtatgcatttatagaatttgcttcatttgaagatgctaaagaagctttaaattcctgtaataaaatggaaattgagggcagaacaatcaggctggagttgcaaggatccaattcgagaagtcgtaagtcctttgacatgatatgacttggttgggtgatttttttttttatttttatgtgcctatatgctcatttggggctgtctttatgttgttgctgagaaaatgacaactggatatgatgactgattacctgagaaataattgatgaaatctcaagaaaattcctctagatagtcaagttctgatccagctatgtcaactcaaagcagcaaccttgattgccctctgagtacgctttttttttgatccagtgtagtctttttttttttaaccttaatttcttgtgttaattgctttttctggtaaaagggggaaaaaaagacataacaaaatcagtgtaagggaaggctcagtggttgagcactgagaggacctgggttcaaatcccagcactcacatggcacctatcgagacaggatttctctgtgtagtcctgcctgtcgtggaactcactctgtagaccaggctggcctcaaactcagaaatctgcctgcctctgcctcctaggtgctgggattaaaggtgtgcgccaccactgcccaaccctgtctgtaactcttaagatctgacatagattgcagacaaaacactaatgcacataaaaaaatttttttttttaaaaaaggaatctacttcagctgaatgtggcagtatggcagtattcaccaagggttcatagtgaaacaggaatttttctcttccagaaccatccaaaactctgtttgtcaaaggtctgtctgaggataccactgaagagaccttaaaagaatcatttgagggctctgttcgtgcaagaatagtcactgatcgggaaactggttcttccaaagggtaagaaggcgtagtagtgttgctgctttttagtgaattctgcatggagaacttgggtctgcagtatcttctcattgagctcctttctgtccatcagtgatagattatggattcgcacgagaagaagagagaattcacagaactggcacttatcttctgtttttgcagaagtatatttggctgttgtgtgagacattatgagatactggcgattttctcgacctgaagagtactttggtcactctacttgggtgacttggtacttattgtgttactttaaaatgtgtttacttaatgggtgaggtttttttgtttttcttttctgttttaggtttggttttgtagactttaatagtgaggaagatgccaaagctgccaaggaggccatggaagatggagaaattgacggaaacaaagttaccttggactgggccaaacctaagggtgaaggtggctttggtggtcgaggtggaggcagaggaggtttcggaggcagaggtggaggcagaggtggaagaggtggatttggaggaagaggccggggaggctttggaggtaaggaagggaaaggaactggaaacggattcctaaacctgtgtcctaaccaaccaccttaaatgggaaggtcagtcctaattgtatcaccctttgatgtttttccttcctataggtagaggaggcttccgaggcggcagaggaggagggggagacttcaagccacaaggaaagaagacgaagtttgaatagttccttccatcccattctttccctcttcattttaaagaaaggactctggggtttttactctgttacctgttcaatgacagagccttctaaggacattccaagacagtaaagatcctaaactctgttgccagacttaatacttcctagaggttacatttggattgttgcttaagagcttggcaagaccaactctgcccagtgggaatttcagttgtgttcctactgctttcaagaattcccagctacaaatgtggaaattggtggggaacagcttcatcatgattctgatctggaagatttaatttgtatcttagaagggtgtgtactggaaaagtggttgatagagcacatggatcagtgctggaaataccatacaagagcttgtgtggtatgtaattctattcccagcataataagaacaaacagtacagtgcaatctgaaatgacctggacaaggaatggtacccattgggttgaaaaattcacatagccaggatggttgcacatgcctttaaccccagcacttgggagggagaggctggtagatctgagtttgatctggtgtacagagagttccagaacagccagggctgtttattagagaaaaaaccctgtcttgaaaaaacaagaaaaaaaaacctcacagacaaccaaatacagagttttagccactgagtaccaagtctcagcagcaagctgggagtgacgtaatccaatcccatgggaggctaaagcagtctatgacttcaatgccagttgggtctgcagaactgagttgctggatagtgagggatacttagaaactttgtcttgaaaaaaaaaacaagacctgtcaaatttgagagaagctt

SEQ ID NO: 102 - DNA, 464 bp, Mus musculus
ttttttttttttttattcttgccaaacacctcaaattttactcattttacaaaagtactaaatgacacacagctacagaaaaaaacacggagcttagcttatatcccttaaagtctaatggtcacatggaaagtcagcacggagtctgtttactataaaagttaaagtcaaaagtacgcattagggtttgaactgttttcgtcttctttctagagatgtgatacacatgctttctgtttggtggcagtccaccaaagatgacagaggaccagaaatctgtgtcctgcccccacccccacccccaggctgagctggatcaggggagcatcaacttagcaggagagattgtatgaaaacaaacagcagagtccctacccccaataacccccccagctcactggcctacacgaaggactgcacacaagcatgcacaagcacacctcgcatgctgtcctgacagagcc

SEQ ID NO: 103 - DNA, 1377 bp, Mus musculus
cgccgagctgtgtgtccaccgccagaccagagttcttttggttggacagatctgtgagtcttcccaggagagcacccttgggctctgctcgcccctgctccttcagggatggaggcaatggcagccagcacctccctgcctgaccctggtgactttgaccggaatgtgcctcggatctgtggagtgtgtggagaccgagccacgggcttccacttcaacgctatgacctgtgaaggctgcaagggtttcttcaggcggagcatgaagcgcaaggccctgttcacctgccccttcaatggagattgccgcatcaccaaggacaaccggcgacactgccaggcctgccggctcaaacgctgcgtggacattggcatgatgaaggagttcatcctcacagatgaggaggtgcagcgtaagcgagagatgatcatgaagaggaaggaggaagaggccttgaaggacagtctgaggcccaagctgtctgaggagcaacagcacattatcgccatcctgctcgatgcccaccacaagacctacgaccccacctatgccgacttccgggacttccggcctccaattcgtgcagacgtaagtacagggagctattctccaaggcccacactcagcttctccggagactcctcctcaaactctgatctgtacaccccctcactggacatgatggaaccggccagcttttccacgatggatctgaatgaagaaggctccgatgacccctctgtgaccctggacctgtctccgctctccatgctgccccacctggctgatcttgtcagttacagcatccaaaaggtcatcggctttgccaagatgatccctggcttcagggacctcacctctgatgaccagattgtcctgcttaagtcaagtgccattgaggtgatcatgttgcgctccaaccagtcttttaccatggatgacatgtcctgggactgtggcagccaagactacaaatatgacatcactgatgtctccagagctgggcacaccctggagctgatcgaacccctcataaagttccaggtggggctgaagaagctgaacctccatgaggaagaacatgtgctgctcatggccatctgcattgtctccccagaccgacctggggtacaggacgctaagctggttgaagccattcaggaccgcctatccaacacgctgcagacctacatccgctgccgccacccgcccccgggcagccaccagctctacgccaagatgatccagaagctggctgacctgcgaagcctcaatgaggagcactccaaacagtaccgttccctctccttccagccggagaacagcatgaagctcacaccccttgtgctagaggtgtttggcaatgagatctcctga

SEQ ID NO: 104 - DNA, 1429 bp, Mus musculus
  modified_base (8)..(8): a, c, t, g, unknown or other
  modified_base (1366)..(1366): a, c, t, g, unknown or other
  modified_base (1371)..(1371): a, c, t, g, unknown or other
  modified_base (1378)..(1378): a, c, t, g, unknown or other
  modified_base (1381)..(1381): a, c, t, g, unknown or other
  modified_base (1386)..(1386): a, c, t, g, unknown or other
  modified_base (1395)..(1395): a, c, t, g, unknown or other
  modified_base (1400)..(1400): a, c, t, g, unknown or other
  modified_base (1408)..(1408): a, c, t, g, unknown or other
  modified_base (1410)..(1410): a, c, t, g, unknown or other
  modified_base (1420)..(1421): a, c, t, g, unknown or other
ttcctggnctgtaggtagcgactacagttagggggcacctagcattcaggccctcatcctcctccttcccagcagggtgtcacgcttctccgaagactggatgactgccatggaggagtcacagtcggatatcagcctcgagctccctctgagccaggagacattttcaggcttatggaaactacttcctccagaagatatcctgccatcacctcactgcatggacgatctgttgctgccccaggatgttgaggagttttttgaaggcccaagtgaagccctccgagtgtcaggagctcctgcagcacaggaccctgtcaccgagacccctgggccagtggcccctgccccagccactccatggcccctgtcatcttttgtcccttctcaaaaaacttaccagggcaactatggcttccacctgggcttcctgcagtctgggacagccaagtctgttatgtgcacgtactctcctcccctcaataagctattctgccagctggcgaagacgtgccctgtgcagttgtgggtcagcgccacacctccagctgggagccgtgtccgcgccatggccatctacaagaagtcacagcacatgacggaggtcgtgagacgctgcccccaccatgagcgctgctccgatggtgatggcctggctcctccccagcatcgtatccgggtggaaggaaatttgtatcccgagtatctggaagacaggcagacttttcgccacagcgtggtggtaccttatgagccacccgaggccggctctgagtataccaccatccactacaagtacatgtgtaatagctcctgcatggggggcatgaaccgccgacctatccttaccatcatcacactggaagactccagtgggaaccttctgggacgggacagctttgaggttcgtgtttgtgcctgccctgggagagaccgccgtacagaagaagaaaatttccgcaaaaaggaagtcctttgccctgaactgcccccagggagcgcaaagagagcgctgcccacctgcacaagcgcctctcccccgcaaaagaaaaaaccacttgatggagagtatttcaccctcaagatccgcgggcgtaaacgcttcgagatgttccgggagctgaatgaggccttagagttaaaggatgcccatgctacagaggagtctggagacagcagggctcactccagctacctgaagaccaagaagggccagtctacttcccgccataaaaaaacaatggtcaagaaagtggggcctgactcagactgactgcctctgcatcccgtccccatcaccagcctccccctctccttgctgtcttatgacttcagggctgagacacaatccccaggatccactcanactgnctgcctntgnatccngtccccatnaccancctccccntntccttgctgnnttatgact

SEQ ID NO: 105 - DNA, 170 bp, Mus musculus
tgttctttcctccctccctccctccctccctccctccctccctcccttccttccttccttcctttagacaagaaaaatcttatctgcctgtgagaaaaaccccacagatgcctgccagctcaattatgacatgcacaacccctttgacatttgtgctgcatcttaccggc

SEQ ID NO: 106 - DNA, 1072 bp, Mus musculus
aagcggccggtggcccgcgggcacggagaggcggcccgccgggtgcaggatggcgacagccgtcgggatgaacatccagctgctgctggaggcggccgactacctggagcggcgggagagagaagctgaacatgggtatgcctccatgctgccatacagcaaggacagagatgccttcaaacggaggaacaagcccaagaagaacagcaccagtagcagatcaactcacaatgaaatggaaaagaacaggcgtgctcacctccgcctgtgcctagagaagctaaagggattggtaccgctgggccctgagtcaagccgacacaccactctgagcttgctgacaaaagccaaattgcatataaagaaacttgaagactgtgacagaaaagctgtccaccaaatagaccagcttcagcgggaacagcggcacctgaagcggcggctggagaagctgggtgccgagaggactcggatggacagcgtgggctctgtggtgtcttcggagcgctctgactctgatagagaactggacgtggacgtagacgtggacgtggacgtggatgtggagggcacagactacctcaatggggacctgggctggagcagcagcgtgagtgactcggacgagcgaggcagcatgcagagcctgggcagtgacgagggctactccagtgccactgtcaaaagagccaagctccaggacgggcacaaggcgggcctcggtctataggagagtcctctccacctcaccgggttaggtagtgtaccggacctgtccagacgcccttgcacgcaaacctcatgtaccaccttgaccaatagcagctctgtccactttgcagaaagcacatagggttgtggtcttgagtgcagtcagtcgcttctctgtccatacatgtcggcactgagagactgcacattccagtcagttcagagcacccaagaatccttagcccaagcaagtgtcacctctcagcagccccctgtgcactgtcctgcagctgacgagatctttcctagttttctggctcacgatgatactcgcccaggagagttggagctttgtctggca

SEQ ID NO: 107 - DNA, 490 bp, Mus musculus
tttttttttttttttttgagtaaatacattttattcagaagaagataataaaatagcatgcactttaaaaccaccaagcgctgataaaaacatatcactgcagccatgattccacatcaaaccttcagtaagaataggcatttaatcttcacatcttgtgctggacctggcatgggtcatctccctccaccagggacctaaaggccaaggccaaggccaagagtgagcaagtggtggagaggggttagtggcaggctcactcctagccctgcagaacagatcagggcaaagccgtgcccttcccagctactgggacacaacactgaccaacgcttgcttctggatggcagagagtggacaggggtaaaactgcaagacagcaggtcctcctgcccttttcaaggtccctgaaaccctcaagggagattcgacaatcccagcagggccgttgctttgttttgctggagtggggattctgcaaggggctcac

SEQ ID NO: 108 - DNA, 1311 bp, Mus musculus
gaattccggctgcccctgctacctctcggtgaccgcctcccaggcctgtcgcagttgggttcgggctcctttgccgagccaccatgtcgcagagcggggaggagaacctgcagggctcctgggtagaactgcacttcagcaatggcaatgggagcagcgttccagcctccgtctctatttataatggtgacatggaaaaaatactgttggatgcccagcatgaatctggacgaagtagctccaagagttctcactgtgacagcccacctcgctcccagacaccacaagataccaacagagctgaaatagacagccacagctttggcgagaaaaacagcactctgtctgaggaagattatattgagagaagaagagaagttgaaagtatcctgaagaaaaactcagattggatatgggattggtcaagtcgaccagaaaatattccccccaaggagttcctttttaaacacccgaagcgcacagctactctcagcatgagaaacacaagcgttatgaagaaagggggaattttctcagcagactttctgaaggttttccttccatctctgttactgtctcatctgctggccattggcttggggatctacattggaaggcgtctgacaacttccactagcaccttctgatgaagatttggatctgacttctgttcacacagtgaaggattcatgtctgagctgtgacagctaattgaagagctagcatggtccttgggtgtttgcactatgtgtgttatttgttctgtaaatgcggtgttcctgatttagtgagacagaatagactcttgtcatgacctataattatacctatgggatcaattaataagcatgtcagactgatgcctattgtagcatttactagtaaatttctttgaatattagatataaatagtaaatttctttgaatattagatataaatagtataaataattttaatatagtagcaatggtgtatttaaaactgatctgtaatcataatccagttaagacactttacacttcaaaagaacaagtaagtgatattaaaatcattaaagggttttccccaaaggaatattgtggccttataatcctattacatagcagaaaattaaagggtgcgtgcgggttatctgtaaaggcctctaactttgtgaactgagtagcaagtagaagctaaggttacccacgaaccccactttgcagttccccctcgtcctgctttgcaggatgaggattctcgccttgctgtccaccattaccttgggtggtcagttttgttgcaggcacctttatcactctgctgaattc

SEQ ID NO: 109 - DNA, 1629 bp, Mus musculus
tcctcgtcctcgtctgttccatcttctccaaatagctctaactgtgatgccaacggcaatcccaagaacgctgatatctctagcatcgatggtgttctgaagagtgaccgcacagattgtcctgtgaaaacaggcaaaaccagtgctcctggcatgactaagagtcacagtggaatgacaaaatttagtggcatggttctactgtgtaaagtctgtggggatgtggcatcaggattccactatggagttcatgcttgtgaaggctgtaagggtttctttcggaggagcattcagcaaaacatccagtataagaagtgcctgaagaatgagaactgttccatcatgaggatgaacaggaaccggtgccagcagtgccgctttaagaagtgtctgtctgtggggatgtcacgagatgctgttcgatttggccgaattcctaagcgtgaaaaacagagaatgctaattgaaatgcaaagtgcaatgaagaccatgatgaacacccagttcagtggccacctgcagaatgacaccttagcagaacagcatgatcagtcagcactaccagctcaggaacagctgcggcccaagtcccagctggagcaagaaaacatcaaaaacactccttctgattttgcaaaggaggaagtgattggtatggtgaccagagcccacaaggatacctttctgtataatcaggaacatcgagaaaactcatctgagagcatgccacctcagagaggagaacggattcccaggaacatggagcaatataatttaaatcaagaccatcgtggcagtgggattcacaaccacttcccctgtagtgagaggcagcaacatctcagtggacagtacaaagggaggaacataatgcattacccaaacggccatgccgtttgtattgcaaatggacactgtatgaacttctccagtgcttatactcaaagagtctgtgatagaattccagtaggtggatgttctcagactgagaacagaaatagttacctgtgcaacactggagggaggatgcatctggtgtgtcctatgagcaagtctccatatgtggaccctcagaagtctggacatgaaatctgggaagaattttcaatgagttttaccccagcagtaaaagaggtggtggaatttgcaaagaggattcctggcttccgagatctgtctcagcatgatcaggtcaatctgttaaaagctgggacttttgaggttttaatggtacgatttgcttcattatttgatgcaaaggaacggaccgtcacctttctaagtggtaagaagtacagtgtggatgacctgcactcaatgggagcaggggatctgctcagctctatgtttgagttcagtgagaagctgaatgccctccagctcagtgatgaggaaatgagcttgttcacagcagttgttctggtatctgcagatcgatctggaattgaaaatgtcaactcagtggaggctttgcaggaaacactcatccgtgcactaaggaccttaataatgaaaaaccatccaaatgaggcctccatttttacaaaattacttctaaagttgccagatcttcgatctttaaacaacatgcactctgaggaactcttggcctttaaagttcatccttaa

SEQ ID NO: 110 - DNA, 2557 bp, Mus musculus
tgaacaaccatcgccaccatgggggagcttttccggagtgaggagatgacgctggcccagctatttctacagtctgaagctgcttattgctgtgtcagtgaattaggagagcttgggaaggtcaatttccgggatttaaatccagatgtgaatgttttccagaggaaatttgtgaatgaagttagaagatgtgaagaaatggatcgaaaactccgatttgttgagaaagagataaggaaagctaacatcccaattatggacaccggtgaaaacccagaggcgccccttccctgggacatgatcgacttagaggccaatttcgagaagattgaaaatgaactgaaggaaatcgacactaaccaggaagctctgaagagaaacttcctggaactgactgaattaaaatttatcctgcgaaaaacccagcagtttttcgatgaggctgaattgcatcatcagcagatggcggatccagacctgttggaagagtcctcatcactcttggagccaaacgagatgggaagaggcgcacccttacgacttggctttgtggctggtgtgattaaccgggagcggatcccgacctcggagcgcatgctttggcgagtgtgccgagggaatgtgttcctgagacaagctgaaatcgaaaacccgctggaggatcctgtgactggcgactacgtgcacaagtctgtgttcatcatttttttccaaggcgatcagctgaaaaacagggtcaagaaaatctgtgaagggttccgagcctccctctatccctgccctgagactccacaggaaaggacagaaatggcttccggggtcaataccaggatcgacgacctccaaatggttctgaatcagacggaggaccaccgccagagggttctgcaggcagctgctaagaacatccgcgtctggttcatcaaggtgcggaagatgaaggctatctaccataccctgaacctgtgcaatatagacgtgacccagaagtgcctgatcgcagaagtctggtgccctgtcactgacccggactccatccagtttgcactacgaagaggcacggaacacagtgggtccactgtccccttcattctgaacaggatgcagacaaaccagacaccgccgacatataataaaaccaacaagttcacgcacggcttccagaacatagtagatgcttatgggatcggcacttaccgagagattaacccagctccgtacactgtcatcaccttcccctttctgtttgctgtgatgtttcgagattttgggcacggcattttgatgacgctgtttgctgtgtggatggtgttgagggagagccggatcctctcccagaagcacgagaatgagatgtttagcatggtgttcagcggccggtacattattcttctgatgggactgttctccatctatactggactcatctacaatgactgcttttccaagtctctgaatatctttgggtcatcgtggagtgtacggccaatgttcactcaagggaactggacggaggagacgcttctggggagttctgttctccagttgaaccccgctatccctggagttcttggtggcccgtacccgtttggcattgatccgatttggaacattgcaaccaacaagctgaccttcctcaactccttcaagatgaagatgtctgttatcctcggcatcatccacatgctgtttggagtcagcctgagccttttcaaccatatctatttcaagaagcccctgaacatctactttggctttattcctgagatcatcttcatgtcctcgttgtttggctacctggtcatccttatcttttacaagtggacagcctacgatgcccactcgtctaggaatgccccgagcctcctgatccacttcataaacatgttcctcttctcctacccagagtctggtaatgcaatgctgtactctggacagaaaggaattcagtgtttcctcatcgtggtggcgatgctctgcgtcccttggatgcttctgtttaagccgctgatccttcgccatcagtacctgaggaagaagcatttgggaactctcaactttggttggatcagggtgggcaacggaccgacagaggaggatgctgaaattattcagcatgaccagctttccacccattcagaggacgcagaagagtttgactttggcgacaccatggtccaccaggccatccacaccattgagtactgcttgggttgtatctccaacaccgcgtcgtacctgcgactctgggccctcagtctggcccacgcacagctctctgaagtactttggaccatggtgatccacattggcctgcacgtccggagtttggcggggggtctagggctgtttttcatcttcgccgcctttgcgacgctgaccgtggctatcctgctgatcatggaaggcctctcggccttcctcctcgcgctgcggttacactgggtggagttccagaacaaattctacactgggactggcttcaagttcctccccttctcctttgagcacattcgggaagggaagtttgatgagtgagtctcaggcagggcgcatg

SEQ ID NO: 111 - DNA, 3168 bp, Mus musculus
catccttccttgggaaacagctttatttacaaaacaagtctaaaataagaacaggaagtgacgagcctagggagtccagatctagctttagggagccacagagaaagcccagacatacaaagagcctaaaggcaggccagctatgcgagcaggacctaaaatttgaactccttgtatttcttgctgcccccacggctgtcctggggctgagctttccgtttcttttgcttctgcttagcagcatgctcagccaccatgtcgctgaagtcttccttctctacttgtgcctgctgctcccgaacgtgctcctcgtacttctgcgtcatggccatggggtccaactccaattcctcaggcgccagcgctacttccacaccttgcaattcaggggctgggcccttccggctcataaccgtggacatgtcataaatgtgggtggatcccatcatggctcccctaacagtggctgttctcttctctggcaatacagtgaataactgaggtgtctcacttccatccatcgcctcttcaatcttcttcttcctcagctcaatgagttcaggggtctccatcccagctggcacggatgagaatcctccgggagtgatgaggccgctgtctgcaggtgtgatgaagccagtctcatctggcttgtcttcatcgctttcctcctcctcctcctcttctgaggattcttcatcagatggttccagttccccccacggggtccggtcaatttcttcttcttccgttttggtctgaaactcagcagcattggttccaaacacgtccccatagagcctctggtgaccatggccaaaaaaaggattgctgtaattggagcaggagctagcgggctcacctgcatcaagtgctgcctggaagagggcttggaacctgtctgctttgaaaggtctggtgacatcggaggactgtggagattccaggaagcccctgaggaaggcagggccagtatttaccagtccgtggtcatcaacacctccaaggaaatgatgtgtttcagtgactaccccatcccagatcattaccctaactacatgcacaactcccaagtcctagagtatttcaggatgtatgccaaagaatttgaccttctcaaatatatccaattcaagactacagtgtgcagcgtgaagaagcagcctgatttctctacctcgggccaatggcaggtggtcactgagtgtgaagggaaacagcaggtagacgtcttcgatggagtcctggtgtgcacgggtcatcacacggatgctcacctgcccctggaaagctttcctggaattgaaaagttcaaaggaaagtactttcacagccgagactataagaacccagtggaattcaccgggaagagggtcattgtaattggcattgggaattctggaggggatctggctgtagagattagccacacagccaagcaggtattcctcagtaccaggagaggagcttggatcttgaaccgtgtaggcaagcatggatatcctattgacctgctactctcttctcggattatgtactacttgtcacgtatctgtggtccatcactaaaaaacaactatatggaaaaacagatgaaccaaaggtttgatcatgaaatgtttggcctgaaacctaaacacagggctctgagtcagcatccaacggtgaatgatgacctgcccaatcgtatcattgctggcttggtgaaggtgaaaggaaatgtgaaggaattcacagagaccgccgccatttttgaggatggctccagggaggatggcattgatgtggtcatctttgccacaggctacagctttgcctttccttttcttgaggactctgtcaaagtagtcaaaaacaaggtgtccttgtacaaaaaggtctttccacctaacctggaaaaaccaacacttgcaatcatcggcttaattcagcccttgggagccattatgcccatttcagagctccaaggacgctgggccactcaagtgttcaaagggctaaagaaattgccctcacaaagtgaaatgatggcagaaataaataaggctcgagaggaaatggcaaaaaggtatgtggacagccagcgtcataccatccagggagactatatagacaccatggaagagattgcagatttagtgggtgtcaggcccaatatccagcctctggtcttcactgaccccaggctggcattacggttactactggggccctgtactccagtccagtatcgcctacagggccctggaaagtgggctggagcccggaaaactattctcaccacggaagatcgtgttcggaagcctctgatgacaagagtggtggaaagagacagctctggggggtcactggtgacagtgcgtgtcctcatgctggctgttgctttctttgctgtcatcctggcttatttttagatgtggcagcgcagtacttgagctgccaccggaaaacgccatctagccacaccttcagaacctgatgagactgaacacagcttcatactgcacaggaatcaatcacaatctctctctctctctctctctctctctctctcttctctctctcactctccctccctcactttctctctctctctcttctcccttcctccccctctctctcctccctcaatcattaatccttcttgttttatttctgtgatattgggttttcactaattgattcatctccctccctcgtgagccttttgtctctccctctagtcattcccagaccgtgagctcaggcccccttcatcatctttgtatgtcattagcagggttcttttaatgcttgactctgttgtgtttctagcactgcacagctagacctcgctggatgataacccatcttgaaaagactgcttccattatcaagcgcatattggcagcacttgaccttataagcagagcccacatatctatttcaggaattcccacagagggcagtccagaaagaagagccacttcgtgctgaagactgggagtccaaaatccagggtgcagacagtgaggcattcctgtcttcatgactaatacagtgagggtatcacatgggcaaaacagaaaatagctaagttccggcatgtggcacatgctgaataaatgctcgttgatatgtatgaaataaggtgttatctctaagtcaatctaataaatggctaactct

SEQ ID NO: 112 - DNA, 817 bp, Homo sapiens
agtcctgcgtccgggccccgaggcgcagcagggcaccaggtggagcaccagctacgcgtggcgcagcgcagcgtccctagcaccgagcctcccgcagccgccgagatgctgcgaacagagagctgccgccccaggtcgcccgccggacaggtggccgcggcgtccccgctcctgctgctgctgctgctgctcgcctggtgcgcgggcgcctgccgaggtgctccaatattacctcaaggattacagcctgaacaacagctacagttgtggaatgagatagatgatacttgttcgtcttttctgtccattgattctcagcctcaggcatccaacgcactggaggagctttgctttatgattatgggaatgctaccaaagcctcaggaacaagatgaaaaagataatactaaaaggttcttatttcattattcgaagacacagaagttgggcaagtcaaatgttgtgtcgtcagttgtgcatccgttgctgcagctcgttcctcacctgcatgagagaagaatgaagagattcagagtggacgaagaattccaaagtccctttgcaagtcaaagtcgaggatattttttattcaggccacggaatggaagaaggtcagcagggttcatttaaaatggatgccagctaattttccacagagcaatgctatggaatacaaaatgtactgacattttgttttcttctgaaaaaaatccttgctaaatgtactctgttgaaaatccctgtgttgtcaatgttctcagttgtaacaatgttgtaaatgttcaatttgttgaaaattaaaaaatctaaaaataaa

SEQ ID NO: 113 - DNA, 2566 bp, Homo sapiens
ggcacgagttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatataccctttggatttcaaacagtaacatcggatgtaaacaaacttagttccttttactcactgaaactaatcaagcggctctacgtagacaaatctctgaatctttctacagagttcatcagctctacgaagagaccctatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaatttcctgaatcagaaacaaaagaatgtcctttcagactcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagacctttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaacctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatgtggttggcactagactggtggcaggggcttctagctgactcgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttgggtggataagctatccctgttgccggttcatggattacttctctataaaaaatatatatttaccaaaaaattttgtgacattccttctcccatctcttccttgacatgcattgtaaataggttcttcttgttctgagattcaatattgaatttctcctatgctattgacaataaaatattattgaactacc

SEQ ID NO: 114 - DNA, 475 bp, Homo sapiens
ttttttttttttttttttttttttttaggcacatatttatttaattttttttaatataaaagtaaaagagtacattgttgagtagaggattaaaggagtgacgaccctttctaaagtggggtctcccatcccggatccctaagactgtaacatctgctacatacattaaaaacaaaacaaaacaaaagcaaacatgaaacttatgacctgacttcactccacccttcatgcctgcattatgacagaaacacgtcccactgctcctacttatgtatgtacatccagagctccaaacctaagctgtggccccctcctcccagccctacccacatccacccttatttcccaaaagcctgtagaagcccccacttagaaaaaaaggcagacatacacatacacagaaacacatatctatctgcagctcctccatgtgaagcccctgaaacatacacaccctggaactttcctctcctta

SEQ ID NO: 115 - DNA, 696 bp, Homo sapiens
  modified_base (570)..(570): a, c, t, g, unknown or other
  modified_base (602)..(602): a, c, t, g, unknown or other
  modified_base (639)..(639): a, c, t, g, unknown or other
tttttttttgcagctagtgcggagttttattggctacaaaatagatgcaaaatgatgagaatctgaaggctgcagtaggaaagtagagctttaccctcataaactcgcactttgattagaaaagtgcaatatattaagagcattatgagaagtctggtgagactgttacagaaaaaaaaaaaaagtttctgagtctgataattccaagggtatcttttaagaactcactcactggtgtctgtgcaaggactttccttgggggaaaatagattttacaacaggcggaaactttcattggtctcatgcgtgcttttggatttcattcacttgacaaagaactaatcttccgttgatggtctcctgggttatggccttgatctttggagttgcagacactttcatgctcgactttgattcttcccgtgtcccttcactctctccctccaggagccgtcggtacgtggtgatttccttctccaggtgggttttgatgcccagcagcacttggtattcattgttctgccgctccagttcatggcgtagctgcgtcagttccctcctcatagtggngagatgatctccttgcatggtcctggagcttngcaggagtacccgagactgggtctcggataacatgtnttccaaagcaagattcgtgctgtactgtgtctgcaggtcaatctcaggggcctgaat

SEQ ID NO: 116 - DNA, 569 bp, Homo sapiens
  modified_base (246)..(246): a, c, t, g, unknown or other
ttagcataaaataagatggtagatttaattacattaaatacacaatggacaaaatgctccagttaaaagacaaggtgtgttttatatgctattaacaaaaaaaaaaatgaaattaaaaatacacaatttacaatagactaaaagaaacataaaatatttacaaatcaaacttaagataagcaagaccacaatggacaaaaatataaaatcctattggtaaaccttaaagaagacccaaatggaaangagaggtaaaccatgttcatgaatcagaaaactcaatattgtaaagacgtcaattttcccaaaactgattgatagctataataaattcccaaactatcaagtgcatcattgttgttggaattgacaagctgattttaaaacttatatgggagaaaaaccttacatgaaaatacaaagagccagaatagtcaagacactctcaaagaagaaaaataaggtggaaaagacttactttatcagatctcaatacataattgataataatgaagacagcttgatattggcacaagaacagacagactaatggaacagaggaaagaatc

SEQ ID NO: 117 - DNA, 429 bp, Homo sapiens
  modified_base (23)..(23): a, c, t, g, unknown or other
  modified_base (25)..(25): a, c, t, g, unknown or other
ttttttttgttattaaaagcaantnaatgagggcagagcaggaaacatgcatttcttttcattcgaatcttcagatgaaccctgagcagccgaagaccagaaaagccatgaagactttctgcttaattcaggggcttacaggattcttcagagtgtgtgtgaacaaaagctttatagtacgtatttttaggatacaaataagagagagactatggcttggggtgagaatgtactgattacaaggtctacagacaattaagacacagaaacagatgggaagagggtgtccagcatctggtggttggcttctcaagggcttgtctgtgcaccaaattacttctgcttggtcttctgctgagctgggcctggagtgaccgttgaaggacatggctctggtacctttgtgtagcctggcacaggaactttggg

SEQ ID NO: 118 - DNA, 567 bp, Homo sapiens
tcacttttttcatttttttttattaatcaaatgatacaaaacaaccatcattctgtcaatgcccaagcacccagctggtcctctccccacatgtcacactctcctcagcctctcccccaaccctgctctccctcctcccctgccctagcccagggacagagtctaggaggagcctggggcagagctggaggcaggaagagagcactggacagacagctatggtttggattggggaagagattaggaagtaggttcttaaagacccttttttagtaccagatatccagccatattcccagctccattattcaaatcatttcccatagcccagctcctctctgttctccccctactaccaattctttggctcttacacaatttttatccctcaaatattcatccctggcccaaccagtcccctgagcctccctctggtggagactcctccacccatgagctccccagagcatccaagacagagtgcacagagaccctgggaaggaagctgaactttgcagagatgaggacaggtgcaggctagggtacagggtggtggtagaggagaca

SEQ ID NO: 119 - DNA, 556 bp, Homo sapiens
ttttggaataagtcaaaatattttatgctgagactgtcttagaaaatccaagacctgtcatccctgtgtatatgttcttatacctccagctaggcactcagtagacatgtgaatctcccttgtctttgatgctgactccctctcacattcctctcatcctcaatcaacacattacatggtttttccatgaatcaatctttattggtgtttgcagcaattgaattattggcataaggcacaatgggcttcaaagcaaatgacagaaagaaaatacgattgtacaggtggaaaggctcttcagggaggtgtcccagagcaactgtgaccctcacaaagaccctgcagctaggacccagcccaactaagacaggctttgaggacctgagagtgaccaagccatacctcagggaatctgaaggggtcccacagttctttcaaagacaagcatttctagcttccttgggagctcttccagcctttgagtctttgtcatcaacagcagcttgatgaccatggggaccctgtccctctaagccagcctgctctccctcacctg

SEQ ID NO: 120 - DNA, 677 bp, Homo sapiens
  modified_base (123)..(123): a, c, t, g, unknown or other
  modified_base (203)..(203): a, c, t, g, unknown or other
  modified_base (437)..(437): a, c, t, g, unknown or other
  modified_base (530)..(530): a, c, t, g, unknown or other
  modified_base (546)..(546): a, c, t, g, unknown or other
  modified_base (568)..(568): a, c, t, g, unknown or other
  modified_base (610)..(610): a, c, t, g, unknown or other
  modified_base (622)..(622): a, c, t, g, unknown or other
  modified_base (646)..(646): a, c, t, g, unknown or other
  modified_base (652)..(652): a, c, t, g, unknown or other
  modified_base (657)..(657): a, c, t, g, unknown or other
tgaacatgaagccggccactgcctctgctctgctcctgctcctgctgggcctggcctggacccaggggagccacggctggggtgcggaccgtcatcactgcagaaacgtgcaggcagagcgantcagaactacaattacaaccagcatgcgtatcccactgcctatggtgggaagtactcagtcaagacccctgcaaaggggngagtctcaccttcttcctcggcttcccgggtgcaacctggcctgctgcagtgggtgaagttttggtaggcaatttcttgcaaccaccaccgaggccccgaaaagcactggtcgtcagggagctcctccccttggcccccagcctgtgccagccctggcccggctgccacacctctgtttcctaggctggggacccagcttgtctctccttgtttcttcccactgcactgtggtnttcagtggccaccagcctcgtcacatacaccagcattttctgtactctccctttggtgactgaagtactgtgacagttctcaggaaggagganttctacttttgagttntctgtggaaataaaacatgaanttgtttcctaaaaaaaaaaaaaaaaaaaaaagtggggcgaanttttccctagtngggtaattagttgatgcgtgtttnaagcgnatggnaactgggtccaattaacctt

What is claimed is:

1. A method for the treatment of colorectal cancer comprising administering to a human subject diagnosed with colorectal cancer an effective amount of CPT-11, and an antibody to Ly6D/E48 (SEQ ID NO: 27).

2. The method of claim 1, wherein said cancer is colon cancer.

3. The method of claim 1, wherein said colorectal cancer is adenocarcinoma.

4. The method of claim 1, wherein the antibody is an antibody fragment.

5. The method of claim 4, wherein the antibody fragment is selected from the group consisting of Fab, Fab', F(ab')$_2$, Fv fragments, diabodies, linear antibodies, single-chain antibody molecules; and multispecific antibodies formed from antibody fragments.

6. The method of claim 1, wherein the antibody is administered in the form of an immunoconjugate comprising a LY6D/E48 monoclonal antibody.

7. The method of claim 6, wherein the immunoconjugate is a LY6D/E48-MMAE immunoconjugate.

8. The method of claim 1, wherein the antibody is humanized.

9. The method of claim 1, wherein the antibody is a human antibody.

* * * * *